United States Patent 7,745,391 (HUMAN THROMBOSPONDIN POLYPEPTIDE) - sequence listing, part 134

SEQ ID NO: 363569 - DNA, 2205 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcgagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363570 - DNA, 2199 bp, Homo sapiens
gccggcggtcgcgccagcgggatccgcctggctcagctgacagctcccgagaacggaagaggcggcgcgccggttgagcagggcgtttctaggcctggtcggctggcggcggtgagtgggccccaggcaagggcggagggcggaactttggggttcggcactgccgggcggccggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaaagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363571 - DNA, 1759 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtaagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363572 - DNA, 663 bp, Homo sapiens
tatcaggcagcttccctccattaaccaggatctgatataagcccagattgcttacttaaaagcagcttgtaaatctgaacaaggactctgaggttgaattctgttagtgattgtttcagatgagttgactttttgataaaactgaaagaattaattttaaaacttggatagtatttttaaactattctttttctaaccattattctaggatacgaacagggctaggactcctaatggaagaaaaatagtttatttttagaactagatctctttgtcctacatgaggtatatggcagtactaaaagattaaagaacagaaaaaagtcttccatttcagtggctaaaatgtacagctatttctctaccttacggagtcttgctatttctcttcttctcgtggtacttcttgcttctgactttatgttctactctggctcatgttgccgaatagtttaagaagtgctccagtaagaatgtttgtactgttttgtatgtagcacagtgtatcacagcagtaaaaaatagtgttagaataagggcctaacttgcaagtggaaaagatttctagggaaaccaggagttggcagcagcatcatctttccaaactcaccaacatcttcatgtgttttctcctagctatctgctctatgcaagcacttagac

SEQ ID NO: 363573 - DNA, 433 bp, Homo sapiens
gaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtaactgtttaccctgctgatggttgcctcctaattctcttccataaatggagatatcatctcaggaacttccttgatagggctcatggggcagtccgaggccttggagccagcccacaagttgttttgctgtatccattaaaaatgctatggtcttagtctactgcttaag

SEQ ID NO: 363574 - DNA, 3114 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363575 - DNA, 983 bp, Homo sapiens
tggggatagctctctgggcgcgcgaggcagagaaggggaccgggctgggactgtacactgggcctcagtccctcaaatccgggaccgggcgtccgcagctcggctggccgggactcccttcgggacgctgaggaggaaggggaaggtgtgggccctgctccttcgggacgccccaggctggccagcagctcacacatccgcattgcgccctctgatcccagcgttggggcggatagctagcgttgggcctgcccctgttttggggcagtcgcccaaacgacgccgcacgcctagtggcgagctgaacccagactaggacacccgaagaccaaatggatagagtgagaaggaaatgggggttagcaacctgaattgaggtactggattccaagtgacagcttcacaagctgaaatcttgtaggatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagtcagcttttctgcttctatgccaagcactttaaaacaacccttatggggaaaaaccaaccgtgggcaaccggggg

SEQ ID NO: 363576 - DNA, 2896 bp, Homo sapiens
tgcatgggcttcctcacttttttcctcacgaagaggtctctggtctcccctctctgagcactctgaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363577 - DNA, 3617 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctc

SEQ ID NO: 363578 - DNA, 2962 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcgctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363579 - DNA, 2840 bp, Homo sapiens
tgcatgggcttcctcacttttttcctcacgaagaggtctctggtctcccctctctgagcactctgaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363580 - DNA, 2994 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363581 - DNA, 2586 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363582 - DNA, 2118 bp, Homo sapiens
agctgaagacctgttatgtagaggaaatacgaggggtggtgctagaagacagacatctgtggaatgattcacatcctctcaagttaggaggatggaggcctgcttcattaagaagctgggggtagggtggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363583 - DNA, 731 bp, Homo sapiens
gccggcggtcgcgccagcgggatccgcctggctcagctgacagctcccgagaacggaagaggcggcgcgccggttgagcagggcgtttctaggcctggtcggctggcggcggtgagtgggccccaggcaagggcggagggcggaactttggggttcggcactgccgggcggccggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacactaggagaaccgtgacgtggctgttgctgatgcatctag

SEQ ID NO: 363584 - DNA, 5852 bp, Homo sapiens
accgagtctgcggggctggatgctgaccgcccggaccagcacctaggcgggcgggagctgtgcggcccagggttcgcgcgggccgggtagaggctcgagctgggacccccgagcgtgaaccccggagccggcggcgctggggccagaggggccgggagccccagggaggcggatctgggccccgagaaggacacccgcctggatttgccccgtaggcccggcccgggcccctcgggagcagaacagccttggtgaggtggacaggaggggacctcgcgagcagacgcgcgcgccagcgacagcagcccgccccggcctctcgggagccgtggggcagaggctgcggagccccaggagggtctatcagccacagtctctgcatgtttccaagagcagcagaaaatgaacacattgcaggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttacaacagctccactcgaggcatctcacagctctggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaagcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 363585 - DNA, 4323 bp, Homo sapiens
aagtgatccagctggcttggcctcccagagtgctgagattaccggcgttagcaccacgcccagccttcccgttttttctgattggcctgacttcttctttttctctttggtagcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaagcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 363586 - DNA, 1831 bp, Homo sapiens
  misc_feature (30)..(30): n is a, c, g, or t
cacgaagagtatgactagtcgagcctggcntttaatcggacgaggctactccaactccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 363587 - DNA, 1097 bp, Homo sapiens
acttaactgacctcactggaggctacgtcacccaaagtagatgttagaaaacctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 363588 - DNA, 835 bp, Homo sapiens
ttgagacagtgtctctcacccagtctggaatgcaacagcgtggtctcggctcactgcaacttccacctcccaggttcaaaggattctcgtgcctcagcctcctgagtagctgggactacaggcatgtgactctatgcctggctaattttttttgttatttttaagtagagacggggttttgccatgttggcccaggcaggcggatcacttgaggccagaatttgagaccagcctggccaacatggtgaaaccctgtatcactcttttagacccttctgagtgtttgcaggttgagtgttcacagggtgttagcctattgagctttcttttgcggttcttatgcaggtgatttctgcctttgcaggccggagccctcatgacttcagtgacctgcttctgcccctctaggtctatcagccacagtctctgcatgtttccaagagcagcagaaaatgaacacattgcaggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctggtaagttagtagagtatcaaatgttaaaaaatgctcatcccagacctttgggagtgactaaa

SEQ ID NO: 363589 - DNA, 357 bp, Homo sapiens
aaaggttctaactttgataaggtaaaaaatggagcatttctgttatgcagcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctggtaagttagtagagtatcaaatgttaaaaaatgctcatcccagacctttgggagtgactaaagagttgtttatatgtattcggtaccctcagtaacacctcccaacccccaaatatcactttccttcc

SEQ ID NO: 363590 - DNA, 5902 bp, Homo sapiens
ttgagacagtgtctctcacccagtctggaatgcaacagcgtggtctcggctcactgcaacttccacctcccaggttcaaaggattctcgtgcctcagcctcctgagtagctgggactacaggcatgtgactctatgcctggctaattttttttgttatttttaagtagagacggggttttgccatgttggcccaggcaggcggatcacttgaggccagaatttgagaccagcctggccaacatggtgaaaccctgtatcactcttttagacccttctgagtgtttgcaggttgagtgttcacagggtgttagcctattgagctttcttttgcggttcttatgcaggtgatttctgcctttgcaggccggagccctcatgacttcagtgacctgcttctgcccctctaggtctatcagccacagtctctgcatgtttccaagagcagcagaaaatgaacacattgcaggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttacaacagctccactcgaggcatctcacagctctggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaagcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 363591 - DNA, 4907 bp, Homo sapiens
gtcactgtagataggtatgcattttccagaatattctataaatcatacatttaagttttaaatatttggcttttcttactgactttgtcagatagatttggccagattgttagcagtaaaaattaaaagcattattctcttcccttcatgttattaagaaagatgtcatgaccgtggatgaaatcgtaaaagaatgttgccttcaataaagcatctaactgtcttctcttttattaggcctgggtctctgaagagaggcctcaattctcagagctcagatgaccacttgaataagagatcccgaagctcttccatgagctccttgacaggcgcttacacaagtggcatccctagctccagccgcaatgccattaccagttacaacagctccactcgaggcatctcacagctctggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaagcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 363592 - DNA, 4516 bp, Homo sapiens
ttgagacagtgtctctcacccagtctggaatgcaacagcgtggtctcggctcactgcaacttccacctcccaggttcaaaggattctcgtgcctcagcctcctgagtagctgggactacaggcatgtgactctatgcctggctaattttttttgttatttttaagtagagacggggttttgccatgttggcccaggcaggcggatcacttgaggccagaatttgagaccagcctggccaacatggtgaaaccctgtatcactcttttagacccttctgagtgtttgcaggttgagtgttcacagggtgttagcctattgagctttcttttgcggttcttatgcaggtgatttctgcctttgcaggccggagccctcatgacttcagtgacctgcttctgcccctctaggtctatcagccacagtctctgcatgtttccaagagcagcagaaaatgaacacattgcaggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttacaacagctccactcgaggcatctcacagctctggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaagcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagtgttgaagccgtccttccacacttccattctcatgcaatgaaatccaaagttccgttgagacggcttcaacggaactttgtttgtattttttgtagggcggagttttgtcatgttgcctaggctggtctcgaactcctgagctcaagtgatctgcccaccttgccctcccttaagtattgggattacaggcatgagccaccatgcttagcttgtgatggctcttagtgtacatacctgggacatataactgtgccttcttcaaagtagttatctcagaatgcttagcaagcctctctttgacttgactttaaaagctttgaacactagatcctaactttttgaagtaaacttttgattttgaaatggttgaaagttccgttgacctcgagg

SEQ ID NO: 363593 - DNA, 1898 bp, Homo sapiens
ttgagacagtgtctctcacccagtctggaatgcaacagcgtggtctcggctcactgcaacttccacctcccaggttcaaaggattctcgtgcctcagcctcctgagtagctgggactacaggcatgtgactctatgcctggctaattttttttgttatttttaagtagagacggggttttgccatgttggcccaggcaggcggatcacttgaggccagaatttgagaccagcctggccaacatggtgaaaccctgtatcactcttttagacccttctgagtgtttgcaggttgagtgttcacagggtgttagcctattgagctttcttttgcggttcttatgcaggtgatttctgcctttgcaggccggagccctcatgacttcagtgacctgcttctgcccctctaggtctatcagccacagtctctgcatgtttccaagagcagcagaaaatgaacacattgcaggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttacaacagctccactcgaggcatctcacagctctggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttggtatggtcttgtccatctactcctgccctccccggcttagctctcctaagtcttaggaacgctaaggacaagtttcttctggttttttttctaacttatttttgtttttgttttttgagacaacatccctctgtcacccaggctggagttcagtggctcgattttggctaaccgtaacctctgcctcctgagttcaagcaattctc

SEQ ID NO: 363594 - DNA, 850 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctggcttgggaccattagagccagggaaccatcgg

SEQ ID NO: 363595 - DNA, 359 bp, Homo sapiens
  misc_feature (20)..(20): n is a, c, g, or t
  misc_feature (28)..(29): n is a, c, g, or t
  misc_feature (33)..(33): n is a, c, g, or t
  misc_feature (37)..(37): n is a, c, g, or t
aattcgcggccgcgtcgacnggcgcggnngcgncgangggggaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaa

SEQ ID NO: 363596 - DNA, 475 bp, Homo sapiens
ttaggctaggtacgaggctgggtggtctggctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363597 - DNA, 1344 bp, Homo sapiens
  misc_feature (1012)..(1012): n is a, c, g, or t
  misc_feature (1116)..(1116): n is a, c, g, or t
gcacattgcttggggggagctcacctcacccaccctctgccattccagatgataatctacctcactttccctgtggctatgttctgggtttccaatcaggccgagtggtttgaggacgatgtcatacagcgcaagagggagctgtggccacctgagaataagaggagtgtttgagggttcattccaggggtgggagagggtgtggggcagcagtctgctggggactaatgtctgcctcccataagccgaccctgccctgatgtggggctctggaggcctttggctcgtgtcccatttgtgacttttccttacagagggagctgtggccacctgagagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaattcaaaaaaaaaaaaaaaaaagcaaaaaaaaaaaaaaaaaaaaagaaaaaagaaaaaaagacgagaagagacccgaaccagaaaaacaaccaccaaaagggaacgacaccacaagaacaaacacacaaacaaagagggagaggggggcgcgcccaaaaatacaatcccccaggagggggcgccaacaacagccgcccacccccttcctaggcgacaggcggcgccccacacaggggccgcaccccataaaacaccacgaagggacgcgcgccgacccaaacaaccaccgacgcccgagaatggagaacacacaacgccgccacgcgcgggtcatacaggaacgacagaccgcccccacaactctgagggggggacgagcaacgacatcgtagggcggcagcaaccccccccccaacgcagaatattctcaccgaggtcgtccgcgcgggcacacaacatcccacacctaccactcgacggtgagacgaatacgttacgaggccgagaccanacacaacacccacacactcgctccacaacttcgtgcggcgctgaggtcaacaaaccacgcatcttacgccactcgccacgcgagcgtaagcgctcttactatcntagtcacaagacaacacatattattattaccaccacgccggcacggacgcgctgatctaaatgtacgaataccacgatctccagacccttagagcacactcaactaaccgagaccacagaccgtcaacaatcacactcgcactctgaacgacgcaagcaaatctcgcctatccgactcagcctaccgccagtcacaaccaagcctcacatccaaaatcaacccaacat

SEQ ID NO: 363598 - DNA, 269 bp, Homo sapiens
gagctggaattcgagaactacctacttccctgttctagtctggtccacagccgagggttggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaa

SEQ ID NO: 363599 - DNA, 687 bp, Homo sapiens
cttatttttttctgtagagaacgtctcccttggtctttactactaagctcaagcgatcttccacttcgcttctcaaagtactaggagtacaggcgtgagctgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattcgactccaacaacactagcactacaccccagagccgacttcctgggtagacctgaaggacactgacaagaagtgaggac

SEQ ID NO: 363600 - DNA, 350 bp, Homo sapiens
ggcacgagctcgtgccgaatcggcacgaggttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaa

SEQ ID NO: 363601 - DNA, 2859 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccggggtacgccaggagcgggcatggggggaccctgggagagggtgcggatcacagccggggctctgcaaggcagacgggccatctgggcacaggcacggtgtggttcctggcgtggtgtggttgctgggaggccaaaagcagtgtttcgggtctggtctggggcccagaggacactggggcctctcccagtcccagcttacacaataggcaggggaagtgagacatggtcgctgccaggctggtcctggcagtggtgcagttgggagcgggtggtctgagtgctagaggcagggagtagggtccccagcatgggggctacaccacattgtctatctgggctcccaggggtctctgagggtcccccgcacccatccagcacccacacacagccatgtgtgtgcttgactcttgggtcagcctctcctgtctctctctggccctgtgcgtccccctccagggtgccctcaccccgtccccatctctcccccatccctcatccatctcgctgtgcactgtttctccatatctctctctctcacccttctctctgccttcccctttctctctgttctctgtcttgctcccctcccctctccgtcccccttctgtccccatcttcctctctctgtttcctgcttcatctcttgtctctctctttgccttcatactttgtctcactgcttcttatctctttgcctatctctgcctctgtctttgtctttctctggctcgctctctctccctttggctttctctctccgtctctctctggctcactgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363602 - DNA, 2022 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcaggtgaggccccggggccgcccccgcccacgcctgggtctgtgttaggtgggcggcctggcagcggtgagggcctcctgcctggactttctgcccctgccctgcacagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363603 - DNA, 2004 bp, Homo sapiens
gatgtcgagctcggccctactgtctcttagaaacgagatgggggtgaagctggagatatttcggatgataatctacctcactttccctgtggctatgttctgggtttccaatcaggccgagtggtttgaggacgatgtcatacagcgcaagagggagctgtggccacctgagaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363604 - DNA, 1801 bp, Homo sapiens
caccccccaaaagcaattgccgccaattcctttgttcctgtccccttggcctgccaaaattggttccagataattccttgggcctggaggggccatccaccaatttgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363605 - DNA, 2108 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccggggtacgccaggagcgggcatggggggaccctgggagagggtgcggatcacagccggggctctgcaaggcagacgggccatctgggcacaggcacggtgtggttcctggcgtggtgtggttgctgggaggccaaaagcagtgtttcgggtctggtctggggcccagaggacactggggcctctcccagtcccagcttacacaataggcaggggaagtgagacatggtcgctgccaggctggtcctggcagtggtgcagttgggagcgggtggtctgagtgctagaggcagggagtagggtccccagcatgggggctacaccacattgtctatctgggctcccaggggtctctgagggtcccccgcacccatccagcacccacacacagccatgtgtgtgcttgactcttgggtcagcctctcctgtctctctctggccctgtgcgtccccctccagggtgccctcaccccgtccccatctctcccccatccctcatccatctcgctgtgcactgtttctccatatctctctctctcacccttctctccgaattcttcccttgctctggcccatgctttctaggtccagggaccccaggggagctctgcaacggcccacgggggcctccctccccgtgccaggtgcccctctgtcctcagccaaccctcctgggcactctcagggtaaaagaactccatgttact

SEQ ID NO: 363606 - DNA, 1780 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363607 - DNA, 1125 bp, Homo sapiens
agcgttctagaggttccacggaaaggtgacatagagggaggacacgagtacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363608 - DNA, 339 bp, Homo sapiens
gatgtcgagctcggccctactgtctcttagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaa

SEQ ID NO: 363609 - DNA, 1968 bp, Homo sapiens
tggagccttggagaggtagtctcaggatagtggtgtgacctgtgtgtaggtgggtggggcactggaaaggtgggacctgggtgaggagcagggcctgtggagagactgtccctggacaggggtgggaccttgagagacctggtgctgagatgaggtaggacccaaatgtcctcttgccgaggatcctggggatgtccttggcccgcctctcccatccccttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccggggtacgccaggagcgggcatggggggaccctgggagagggtgcggatcacagccggggctctgcaaggcagacgggccatctgggcacaggcacggtgtggttcctggcgtggtgtggttgctgggaggccaaaagcagtgtttcgggtctggtctggggcccagaggacactggggcctctcccagtcccagcttacacaataggcaggggaagtgagacatggtcgctgccaggctggtcctggcagtggtgcagttgggagcgggtggtctgagtgctagaggcagggagtagggtccccagcatgggggctacaccacattgtctatctgggctcccaggggtctctgagggtcccccgcacccatccagcacccacacacagccatgtgtgtgcttgactcttgggtcagcctctcctgtctctctctggccctgtgcgtccccctccagggtgccctcaccccgtccccatctctcccccatccctcatccatctcgctgtgcactgtttctccatatctctctctctcacccttctctctgccttcccctttctctctgttctctgtcttgctcccctcccctctccgtcccccttctgtccccatcttcctctctctgtttcctgcttcatctcttgtctctctctttgccttcatactttgtctcactgcttcttatctctttgcctatctctgcctctgtctttgtctttctctggctcgctctctctccctttggctttctctctccgtctctctctggctcactgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363610 - DNA, 1194 bp, Homo sapiens
  misc_feature (862)..(862): n is a, c, g, or t
  misc_feature (966)..(966): n is a, c, g, or t
ggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaattcaaaaaaaaaaaaaaaaaagcaaaaaaaaaaaaaaaaaaaaagaaaaaagaaaaaaagacgagaagagacccgaaccagaaaaacaaccaccaaaagggaacgacaccacaagaacaaacacacaaacaaagagggagaggggggcgcgcccaaaaatacaatcccccaggagggggcgccaacaacagccgcccacccccttcctaggcgacaggcggcgccccacacaggggccgcaccccataaaacaccacgaagggacgcgcgccgacccaaacaaccaccgacgcccgagaatggagaacacacaacgccgccacgcgcgggtcatacaggaacgacagaccgcccccacaactctgagggggggacgagcaacgacatcgtagggcggcagcaaccccccccccaacgcagaatattctcaccgaggtcgtccgcgcgggcacacaacatcccacacctaccactcgacggtgagacgaatacgttacgaggccgagaccanacacaacacccacacactcgctccacaacttcgtgcggcgctgaggtcaacaaaccacgcatcttacgccactcgccacgcgagcgtaagcgctcttactatcntagtcacaagacaacacatattattattaccaccacgccggcacggacgcgctgatctaaatgtacgaataccacgatctccagacccttagagcacactcaactaaccgagaccacagaccgtcaacaatcacactcgcactctgaacgacgcaagcaaatctcgcctatccgactcagcctaccgccagtcacaaccaagcctcacatccaaaatcaacccaacat

SEQ ID NO: 363611 - DNA, 430 bp, Homo sapiens
gatgtcgagctcggccctactgtctcttagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagccatgagtaaggaaccgagagcagaggagtagatggtttccttattgccttctcctggaagagtgaagcggatcccacgcggacccctttgcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaa

SEQ ID NO: 363612 - DNA, 252 bp, Homo sapiens
gatgtcgagctcggccctactgtctcttagaaacgagatgggggtgaagctggagatatttcggagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaa

SEQ ID NO: 363613 - DNA, 360 bp, Homo sapiens
gatgtcgagctcggccctactgtctcttagaaacgagatgggggtgaagctggagatatttcggatgataatctacctcactttccctgtggctatgttctgggtttccaatcaggccgagtggtttgaggacgatgtcatacagcgcaagagggagctgtggccacctgagaaaggtaagtgatctcttcttcctgccagagggatggaggaggctggattcttgtatccgggatgggttttagatgaaaattttaggccaggcgcagtggctcatgcttgtaatcccagggcatgggaggctgaggtgggtagatcacttgaggtcaggagttcaaaaccagcctggccaacatggcg

SEQ ID NO: 363614 - DNA, 1916 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363615 - DNA, 351 bp, Homo sapiens
ggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaa

SEQ ID NO: 363616 - DNA, 776 bp, Homo sapiens
ggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaaaaaaaacctttgtggcccgcttggcccaagggatttttaaattggggaaggtttatgcttgggcccgaatttgggcctacttggcccatttccccttttggggggcggtttacaattcaatggcccggggtttaaaagggggggatgggaaaaccctggcggtacccaaattaaatcgctttgaaacaaatccctttttcccaagttggggaataagggaaaggcccccacccgttcgcctttccaaagtttgcccaccttaaatgggaatggaaatttgaaagcttaatattttgtaaaattcccggtaatatttggta

SEQ ID NO: 363617 - DNA, 426 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagccgccccctacccctccctttccagagaaataaactcttcccgtcgctctgccaccagtgcctacctcaccttct

SEQ ID NO: 363618 - DNA, 359 bp, Homo sapiens; identical to SEQ ID NO: 363595
  misc_feature (20)..(20): n is a, c, g, or t
  misc_feature (28)..(29): n is a, c, g, or t
  misc_feature (33)..(33): n is a, c, g, or t
  misc_feature (37)..(37): n is a, c, g, or t

SEQ ID NO: 363619 - DNA, 2129 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggtaagtcaccaggactgggaccctgggctctggggcttgggttcccggggcctgggcttgtaccttctaggtgtctggactccagagtccttggagtcagggacctggtttgctgagggacagggacagccccacaccagccgggaccgggagcctgtcaaagacgaaggcagcgccccccaacatcgtccccaaacctctgcccctgcacaggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363620 - DNA, 1756 bp, Homo sapiens
cccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363621 - DNA, 2419 bp, Homo sapiens
tgagactccccacgtggccctgcctggatgccacccacctgtgtcccttcctctgttcctactagttgttgaagacatcaacaaacggcgggaacccattcccagtctggaggccatttatttgctgagccccacggagaaggtgcctacatgagtgagcgtgtgtgtatgcgcgtgcatgcgtgtacatgtgcatgtgtgtgtatgtctgcatgcatgtgattgcatgtgtgcatgtgtatacgtgtgcatgtgtccatgtgtatgtgtgtgcatgtgtgtgcatgtgtgtgtgcatctgtgtatgcatgtgtgtgcgtgtttgcatgtgtgtctatgtatgtgtctgtgtgcatgtgcatgtgtgtgcgtctgtgtgtgcatctgtgtgtgcgtgtgtatgcgtgtgtgtatgcgtctgtgcatgtgtgtatgcgtgtgtgtgcgcatcagtgtctgcatgtgtgtatatgtgtgtatgtatgtgtgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgcgcgtgtgcccatgtgggtgcgacactagtgtgcatttgcacatatacatgtccccgtccgtccatgtttgcacatggtggcagatggggggtggctgggaggcctaggcagccaatgagcctaggtgtgcaggctcaggcccagagagtgatccaccttccccagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363622 - DNA, 1522 bp, Homo sapiens
tgtataggctaggtacgaggctgtgtggtgaatcggccgagggttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363623 - DNA, 1382 bp, Homo sapiens
agccccggccctaccctggccctgactctcaccttcaaacccatccttgaccccatcccctgatgatgtcccccgtgtctgacctccccgccaggggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363624 - DNA, 1025 bp, Homo sapiens
tggagccttggagaggtagtctcaggatagtggtgtgacctgtgtgtaggtgggtggggcactggaaaggtgggacctgggtgaggagcagggcctgtggagagactgtccctggacaggggtgggaccttgagagacctggtgctgagatgaggtaggacccaaatgtcctcttgccgaggatcctggggatgtccttggcccgcctctcccatccccttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363625 - DNA, 521 bp, Homo sapiens
ggttcctgtctgccaggatcttggcccctgaataccccgtggggggcactcctgaccccggaccccatgcctggggttcctcccctaacctgcctctcggccgccaggacgccgtggaggaccggctggacaggaacctgtggcccttcgtatccgaccccgcccccacggccagctcccaggccgctgtcagtgcccgcttcggtcactggcacaagaacaaggctggcgtagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgccaccagtgcctacctcaccttct

SEQ ID NO: 363626 - DNA, 670 bp, Homo sapiens
ggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaacagaacaaaaaatgttttggggcggccgtgggcctgagaaaaagttttcttagcacacatccgttgggggcgcggggccgcgtgtgtggtaagatagacccttggcgccgaatacggtggtccccaaagaggagaactccgggcgcagagagacatagggcgcttggagttcctctcacccaatttaaaaaaagggccggggggacacccgcaggcgtgttggaccaccactccaagaggaggccgaggagggcaataagcgggatcattacacagggcgtcaagcgagccccggatataaattagcgcgccctgtgtg

SEQ ID NO: 363627 - DNA, 1336 bp, Homo sapiens
  misc_feature (1004)..(1004): n is a, c, g, or t
  misc_feature (1108)..(1108): n is a, c, g, or t
gatgtcgagctcggccctactgtctcttagaaacgagatgggggtgaagctggagatatttcggatgataatctacctcactttccctgtggctatgttctgggtttccaatcaggccgagtggtttgaggacgatgtcatacagcgcaataagaggagtgtttgagggttcattccaggggtgggagagggtgtggggcagcagtctgctggggactaatgtctgcctcccataagccgaccctgccctgatgtggggctctggaggcctttggctcgtgtcccatttgtgacttttccttacagagggagctgtggccacctgagagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaaaaaattcaaaaaaaaaaaaaaaaaagcaaaaaaaaaaaaaaaaaaaaagaaaaaagaaaaaaagacgagaagagacccgaaccagaaaaacaaccaccaaaagggaacgacaccacaagaacaaacacacaaacaaagagggagaggggggcgcgcccaaaaatacaatcccccaggagggggcgccaacaacagccgcccacccccttcctaggcgacaggcggcgccccacacaggggccgcaccccataaaacaccacgaagggacgcgcgccgacccaaacaaccaccgacgcccgagaatggagaacacacaacgccgccacgcgcgggtcatacaggaacgacagaccgcccccacaactctgagggggggacgagcaacgacatcgtagggcggcagcaaccccccccccaacgcagaatattctcaccgaggtcgtccgcgcgggcacacaacatcccacacctaccactcgacggtgagacgaatacgttacgaggccgagaccanacacaacacccacacactcgctccacaacttcgtgcggcgctgaggtcaacaaaccacgcatcttacgccactcgccacgcgagcgtaagcgctcttactatcntagtcacaagacaacacatattattattaccaccacgccggcacggacgcgctgatctaaatgtacgaataccacgatctccagacccttagagcacactcaactaaccgagaccacagaccgtcaacaatcacactcgcactctgaacgacgcaagcaaatctcgcctatccgactcagcctaccgccagtcacaaccaagcctcacatccaaaatcaacccaacat

SEQ ID NO: 363628 - DNA, 3107 bp, Homo sapiens
cacatgccaagcgggctgcgcgcgcccctgcccggcccgggagtccctgacgacgcgcgcgcggctgacgcggggggcggggaggggcggggcaggtgcgggactttaacccggagccccgcccctcgggcgtacaaaaccggagcctcgggccgggctgcgtgagggaggagggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363629 - DNA, 740 bp, Homo sapiens
acaaggccaagagactgaagagtccccagtttctgaggatgccctgaacccttggtgcctcatgccctagattgagtgtgggtttctccctcattcttgagtgatgataggaaagctggcctggctgccccatggcccgggacctttgtcccagagaagaaaggcaggcgcagggcatcactgttgtcctgttccacttcacaggagtggagggagtgacagctttccacttggccctgaccccagtccttcctactgctccccagggccacccagtgctaaaggtaacctcagccaagtgtgaataacgtccagggacttcggtggctcctgtgggtggcagtttctgaatctagaactgccgtccagggtttgcccttagtgcaggcgcctctggcctgccctccaggtttctgccacagggttcagggagtgatctttgcctcaagacagccgccagcttcaactacaccagataacggctgtggctttgtgtgtgtgtgtgtgttttctttctctttcgtcgtccttttttttttttctctctgatgcgtgtgaaggagaggactagaaggaacggttcccacctctcggaggacaacggacccaaagcgatcgatgtgatggcaccctcctcagagtagggaaagccagtcatctccaccccatcccacctcccgcccacccctgcccctccctacctcacaggcatgttgtgagaataaatgaggtaacgtgta

SEQ ID NO: 363630 - DNA, 312 bp, Homo sapiens
cacatgccaagcgggctgcgcgcgcccctgcccggcccgggagtccctgacgacgcgcgcgcggctgacgcggggggcggggaggggcggggcaggtgcgggactttaacccggagccccgcccctcgggcgtacaaaaccggagcctcgggccgggctgcgtgagggaggagggttcatcatgcctagtggcgtataagaagaccccgccaccggtccctccacgcaccacttcaaagccgttcatctcagtcacaccctgcccctccctacctcacaggcatgttgtgagaataaatgaggtaacgtgta

SEQ ID NO: 363631 - DNA, 3846 bp, Homo sapiens
gagcggagcgggggtgaggagagtcgagggaggtgacgcgcgctgccggggcgaggttgcgaggggcggtgttgaagaatgtgtgggcgaacatcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363632 - DNA, 3786 bp, Homo sapiens
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363633 - DNA, 4310 bp, Homo sapiens
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgggtaagtcggacagaggtggcggctgcttctcccctctcctctccctccctccgctctcacctctcctgctctccctaacccacttctccttgctggatttctaataaccaagctgggtttgggttgcgggtggtggcccaggcatgggaggctgggcaggggcgggcgggtggacagatgagcatttgctctgtgagaccagtcacccacgggggccatggctgggccaggaacatggcgtcagctgccctgatgctggtggtcttcctggccccactgcagtaaacaggcaaccttatgaccttgtcctcgtgtgtgtgtgcgtgtgggcttgggcgggatggggcaagggctgagccaagaatgagatgggggctgtgggacccgcttcaggcgcatggtgagcagatgatgcatccgtttctctgtctcccgtgtgtccgggtcaaggcggcctctggtctctggccctcttggtgactcactccttcctgtccccaccccatccaccccctacccacagaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363634 - DNA, 5061 bp, Homo sapiens
cccgcagccgcatctggggcgccgcgccggccggaggagaggcatggggcgcccgcgggccggagccggggcgggggccggggcctaggcgcgcggacctgcgagcggacccgagaggcggcggcggcgcagcggaacggcagagcgggccggaggcggccgaggcgcccggcgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgatactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363635 - DNA, 2959 bp, Homo sapiens
ccagtggagttctccctgtttcacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363636 - DNA, 3585 bp, Homo sapiens
gcccagttgtgtctgtaccagaaatgaggagtgatgccaagcctaggcctggcccagccttagcttctgcaatgcaacctatgtaatcacacccattttacaaggaggaaactggggccatacaacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgggtaagtcggacagaggtggcggctgcttctcccctctcctctccctccctccgctctcacctctcctgctctccctaacccacttctccttgctggatttctaataaccaagctgggtttgggttgcgggtggtggcccaggcatgggaggctgggcaggggcgggcgggtggacagatgagcatttgctctgtgagaccagtcacccacgggggccatggctgggccaggaacatggcgtcagctgccctgatgctggtggtcttcctggccccactgcagtaaacaggcaaccttatgaccttgtcctcgtgtgtgtgtgcgtgtgggcttgggcgggatggggcaagggctgagccaagaatgagatgggggctgtgggacccgcttcaggcgcatggtgagcagatgatgcatccgtttctctgtctcccgtgtgtccgggtcaaggcggcctctggtctctggccctcttggtgactcactccttcctgtccccaccccatccaccccctacccacagaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363637 - DNA, 3122 bp, Homo sapiens
acaaggccaagagactgaagagtccccagtttctgaggatgccctgaacccttggtgcctcatgccctagattgagtgtgggtttctccctcattcttgagtgatgataggaaagctggcctggctgccccatggcccgggacctttgtcccagagaagaaaggcaggcgcagggcatcactgttgtcctgttccacttcacaggagtggagggagtgacagctttccacttggccctgaccccagtccttcctactgctccccagggccacccagtgctaaaggtaacctcagccaagtgtgaataacgtccagggacttcggtggctcctgtgggtggcagtttctgaatctagaactgccgtccagggtttgcccttagtgcaggcgcctctggcctgccctccaggtttctgccacagggttcagggagtgatctttgcctcaagacagccgccagcttcaactacaccagataacggctgtggctttgtgtgtgtgtgtgtgttttctttctctttcgtcgtccttttttttttttctctctgatgcgtgtgaaggagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363638 - DNA, 2450 bp, Homo sapiens
ggttgaaatttcatgtacggggcctgggttcagttgtacactcgctgtacctggtcgtcgattacctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363639 - DNA, 2854 bp, Homo sapiens
gagcggagcgggggtgaggagagtcgagggaggtgacgcgcgctgccggggcgaggttgcgaggggcggtgttgaagaatgtgtgggcgaacatcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctcaacttcctcctctgtaaaacggggacagtccctgcccctccctacctcacaggcatgttgtgagaataaatgaggtaacgtgta

SEQ ID NO: 363640 - DNA, 2629 bp, Homo sapiens
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363641 - DNA, 2472 bp, Homo sapiens
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363642 - DNA, 1161 bp, Homo sapiens
  misc_feature (90)..(90): n is a, c, g, or t
ccagaaccctcgagcctaggagagactgctccaggcgacatgacctgtggtagctggaagtgggacagggaggcgcagccacactcctgncctggtccgagggagatctcaggaaaccgactggggaaatcaccccccacagggacccccacccctcccagcctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363643 - DNA, 2202 bp, Homo sapiens
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgggtaagtcggacagaggtggcggctgcttctcccctctcctctccctccctccgctctcacctctcctgctctccctaacccacttctccttgctggatttctaataaccaagctgggtttgggttgcgggtggtggcccaggcatgggaggctgggcaggggcgggcgggtggacagatgagcatttgctctgtgagaccagtcacccacgggggccatggctgggccaggaacatggcgtcagctgccctgatgctggtggtcttcctggccccactgcagtaaacaggcaaccttatgaccttgtcctcgtgtgtgtgtgcgtgtgggcttgggcgggatggggcaagggctgagccaagaatgagatgggggctgtgggacccgcttcaggcgcatggtgagcagatgatgcatccgtttctctgtctcccgtgtgtccgggtcaaggcggcctctggtctctggccctcttggtgactcactccttcctgtccccaccccatccaccccctacccacagaagcagcgtcccctctcacagtatgtcctcccgacgggacacagactcggatacccaggatgccaatgactcaagctgtaagtcatctgagaggagcctcccggactgtacccctcaccctccctccgctctcacctctcctgctctccctaacccacttctccttgctggatttctaataaccaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttta

SEQ ID NO: 363644 - DNA, 1406 bp, Homo sapiens
  misc_feature (1364)..(1364): n is a, c, g, or t
  misc_feature (1367)..(1367): n is a, c, g, or t
  misc_feature (1380)..(1380): n is a, c, g, or t
  misc_feature (1390)..(1390): n is a, c, g, or t
  misc_feature (1392)..(1392): n is a, c, g, or t
  misc_feature (1403)..(1403): n is a, c, g, or t
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgtgggaagcagggtccctcttcaaagatgttctccggagggaccagactcggatacccagngcnaagatcaagggancactgaaggncncggaggacctnacc

SEQ ID NO: 363645 - DNA, 5052 bp, Homo sapiens
cccgcagccgcatctggggcgccgcgccggccggaggagaggcatggggcgcccgcgggccggagccggggcgggggccggggcctaggcgcgcggacctgcgagcggacccgagaggcggcggcggcgcagcggaacggcagagcgggccggaggcggccgaggcgcccggcgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgatactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363646 - DNA, 4453 bp, Homo sapiens
  misc_feature (4453)..(4453): n is a, c, g, or t
gagcggagcgggggtgaggagagtcgagggaggtgacgcgcgctgccggggcgaggttgcgaggggcggtgttgaagaatgtgtgggcgaacatcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaaaacaaaaagaaaaaaaaaaaaggaagacggggcggggggggcgagcccacggaaacacaacagagagggaggggaggccgagcacccccgcaagccacacagcagcgagtggacgcgaaccggacgctcgcccgcgacaagagtgcacaagacgaggcacgccgggcgcggggagacgacgcagaacgcagcaccaaggaggggaaaagcggcggacggtgggggggtgcatcgtcagtataagatagaaagagacgaaattagtcgttgagttagggaagggcgaagaagaatcggaccttgcaacgaaggaagatgtagttatcggtataggggtcacaaaatagcatcaaagaggtagtagaggtagggacgacagagaagagagagagattagagagagaaagcagaagagaaggggagagagagagagagagtagagaaagaaataagacggaggaggaggatgaagagaaagcgagan

SEQ ID NO: 363647 - DNA, 3522 bp, Homo sapiens
gagcggagcgggggtgaggagagtcgagggaggtgacgcgcgctgccggggcgaggttgcgaggggcggtgttgaagaatgtgtgggcgaacatcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcccctgcccctccctacctcacaggcatgttgtgagaataaatgaggtaacgtgta

SEQ ID NO: 363648 - DNA, 3818 bp, Homo sapiens
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctgggtgcccgggaggggggcccctttttgggggcgaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363649 - DNA, 3018 bp, Homo sapiens
cacatgccaagcgggctgcgcgcgcccctgcccggcccgggagtccctgacgacgcgcgcgcggctgacgcggggggcggggaggggcggggcaggtgcgggactttaacccggagccccgcccctcgggcgtacaaaaccggagcctcgggccgggctgcgtgagggaggagggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363650 - DNA, 2906 bp, Homo sapiens
cgccgctggagatcctttcctgctttggtttccctggcagggttgaactgtggagtgtgtgggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363651 - DNA, 2547 bp, Homo sapiens
tattcctatcgatgacagtttccttttgggggcggcctcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363652 - DNA, 2599 bp, Homo sapiens
ccagtggagttctccctgtttcacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363653 - DNA, 2074 bp, Homo sapiens
caatgggatctgcccgtccccgctgctcgagcgctctcggagtctaggcttgctttctgctccagtgccttgagctcttcccactgtcagtcatcgcttctcgtggcttcctgattccaagtgtgtgttgcttgtgcccgatgcggggaggctggggtggagactccagctgccggcatatggtgggggtagtgccacacaaaacgtggcacctttattttatttttgttctctcctcactgtctcactaaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363654 - DNA, 1202 bp, Homo sapiens
  misc_feature (21)..(22): n is a, c, g, or t
  misc_feature (37)..(37): n is a, c, g, or t
  misc_feature (46)..(46): n is a, c, g, or t
tttttcttttgcactgtagcnnttgagaaacctctgntccgttcgnacttagttttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagagaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctcagccccgaagccagctcagtacctgaggggctgctctatgctgtgtatgcgcctctctggcatccgagacatcctcttggctggcgcttgctgcaggggggaccccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 363655 - DNA, 1904 bp, Homo sapiens
  misc_feature (1722)..(1722): n is a, c, g, or t
  misc_feature (1740)..(1740): n is a, c, g, or t
  misc_feature (1742)..(1742): n is a, c, g, or t
  misc_feature (1747)..(1747): n is a, c, g, or t
  misc_feature (1751)..(1752): n is a, c, g, or t
  misc_feature (1769)..(1769): n is a, c, g, or t
  misc_feature (1772)..(1772): n is a, c, g, or t
  misc_feature (1778)..(1778): n is a, c, g, or t
  misc_feature (1783)..(1783): n is a, c, g, or t
  misc_feature (1790)..(1790): n is a, c, g, or t
  misc_feature (1804)..(1804): n is a, c, g, or t
  misc_feature (1810)..(1810): n is a, c, g, or t
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtctangaaaagtctcagtgctgngngcagngccnngtatggagtcccagaantcncgcagnccggncctcggnacaaaattgaaccngatgcnaacaagcgcactaggccaggacctggacggggtctgggactgcacacacgcggcccccggctttacgggaaagtctcatcaactccccctccgg

SEQ ID NO: 363656 - DNA, 1389 bp, Homo sapiens
  misc_feature (1347)..(1347): n is a, c, g, or t
  misc_feature (1350)..(1350): n is a, c, g, or t
  misc_feature (1363)..(1363): n is a, c, g, or t
  misc_feature (1373)..(1373): n is a, c, g, or t
  misc_feature (1375)..(1375): n is a, c, g, or t
  misc_feature (1386)..(1386): n is a, c, g, or t
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagacggattcagcaggggccaaaagaggaggccagccgttaacaatccaggcacgggtccagtagaggccgactgggaagcagggtccctcttcaaagatgttctccggagggaccagactcggatacccagngcnaagatcaagggancactgaaggncncggaggacctnacc

SEQ ID NO: 363657 - DNA, 486 bp, Homo sapiens
acaccaaatacatgatgccttttctgataccatgtgggtgtccagtagttcagttcaattctgacactatctgtagttagcaaagaccccacagattaaggacccagttccacaagattgcctccatttctgatgctagtggcaagtcccagtacttctgaccatttatagccagtatttataactggctataaatttaggggtttccaccaccccctcctaagttgcgataattgctagaatgcatcacagaactcagtttctgtgagttacatttaccagtttgttgtaaaggatatggctctggaatagccacatggaagtattatgaagggtaaggtgtgtgggaagaggcacagagctcccataccctctccaggcctggcaccctcccagcacctccctgtgttcttcaaccaagaatctccctgaaccctgtcgtttaggggtttttatggaggtttcattatgtagagatgattgatt

SEQ ID NO: 363658 - DNA, 390 bp, Homo sapiens
aataaagcttgtgtaatagacccagaataaatggagatctatgaaatgactgacaaagaatttagaataatcctctaaaagaagttcagggaactacaagaaaatacagatagagaattaagtgaagtttagaaaacagtttataaacaaaatgaaaagtttgacagagaaatggaagaaacaaataaaaaaatcaaatgaaagtcatagtgataaaggatataataactgaaccctaaaagtcaatagaaagcttcaaagaagactggatatggtggcacgtgcctgaaatcccagtactttggggggctgaggcaggctaatcatttgagtccaggagttcaagaccagactaagcaatatggagaaaacctgcctctaccaaaaaaa

SEQ ID NO: 363659 - DNA, 776 bp, Homo sapiens
ctgtttctagaggcattttcctgatcttgcctaacaggatttctttcctaggctgtaaaaatccctgcacatttcaatcagagaaagagtaagacgccacagatagagaaggaagaagagttttgcaacggtatagttgagggttctctgccacacacccagaacaggctattggaggctgggtctggtccagaggcctttgaatcatgccagtatgtcccctggccagaaattctcagttacctcagaacttttcccagcctcaagcgatgaaaagaaactagttcaaaacatggccaacattcccagtactcatgggtattggggggttctccatgttctcaccagcaagcctcacatctgagtctttagtacagcagccaacgctgtgtatgtactaggctgatgcatgcccgttcctaaagaaatacagatgcttgctcatgactttttggatgaatatatctttttggctgtaggcagagtaggctctgcatctgagaatatcacacagaaagtagtttgggtttatctatctaattttattttaatatagaggccaagagcaccttgtgaatgatgcaacagattttaagctcgctcccatacttaccgctccaacaaaggctgtacctcagtttcctggccaatggatcaaaatgatatggctccgatgactggaggaacaccagcgtccttagtcttgtgtcaatttagataaaatgacacagacacatgtggagtcgttttaaggagcagagagtttaatagacaag

SEQ ID NO: 363660 - DNA, 363 bp, Homo sapiens
cattcttttgttcaaattcttccagtgtatccccatcatttttacttcatagaagaagccactgttcaggctgggcatggtggctcacgcctgtaatctcagcactttgtgggaggccgaggcgggtggataatttgaggccaggagtcccagactaggctggccaatatggtgaaaccctgtctttactaaaaatacaaaaaattagctgggcatggtggcgcgcacctgtaatcccagctgctcaagaggctgaggcgtgagaatcacttgaacacagaaggtggaggttgcagtgagctgagattgcactactgcactccagcctgggtgacagagcaagactccgtctcaaaaaaaaaa

SEQ ID NO: 363661 - DNA, 2949 bp, Homo sapiens
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 363662 - DNA, 2842 bp, Homo sapiens
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaaaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 363663 - DNA, 2842 bp, Homo sapiens
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaaaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgatgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 363664 - DNA, 522 bp, Homo sapiens
agagaaaaaagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtaagtatttcctgatttcctacattcagacccaataatgcctccctagctgccaggctggtagtggagagttttgtttggtttgttttatttaagttaa

SEQ ID NO: 363665 - DNA, 2896 bp, Homo sapiens
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaaaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 363666 - DNA, 2916 bp, Homo sapiens
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaaaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttaaaaaacaaaaaaaaagggc

SEQ ID NO: 363667 - DNA, 495 bp, Homo sapiens
ctctccaagatattcccactttgtggatgaggaacctggggctctgaggaattaaggaacttgccaaagaccataaaactcctaagtgacagagccaggattctgccagctgtctggttgcccagtggagtctctgtccatcttgtcaccagcccccgcactgtgtacaggaatggaatcagcattcattgctataaactgcagtaaggtcaaggaggcagaatttgctgcaaggaagtaaagagtcccttctacctttgccagtgctacttaccagttaaaaaaagacatcgttttttgtgatccatactcctgaaggccaaaagcacccagtggacagacgatggctcttacgcctccaatgccaaggcaaatggtcagcagtgctacataaaacagcctgtgctgctctgtttttgctggatgggagcttctttgccacaaacagagttgagaaagctggggacagaggagtgtgagtggaaggagagggga

SEQ ID NO: 363668 - DNA, 1899 bp, Homo sapiens
  misc_feature (2)..(2): n is a, c, g, or t
cngtttttgttcttctaagcaaaagatctccctctctctagccgatgctccccactcagttcatcccgggaatgggccagggaggaaggttctcatgcatcgccccgagctgccaggcgagcttcgggctccttaaattcacaggccaacagcccgcgtcctctccgcgcaggctcccggttgcccgcggtccccggcccagctccttggcctcctcctcgtcggtccgcccctggtggtcttggcgcccgctcgtccagctcggcgcgccggggaccgccggctgcccggggcagtccgcacgccctcggggatctcggctcccggatccgccgcgccggcaggagccggccgggcctggagggagcaagcggatgcgcccacgcccccggcacggggatggcgcgacagggcccgggctccggggtggggctcggcagagctcctgacagctccggggtcggcagcgcgggaggggggagctccgccgctcgccgctcattcccggctcggggctcccctccactcgctcgggcggcgcggggcccgttcgggccgcccgtcgccgcccccgccccccgcgcgcccgcccgccagcccgcctgcgccctcgctcgccccgcgcgcgttcctagggcgccacctctttgcgactagctcacttctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatgaaaaaa

SEQ ID NO: 363669 - DNA, 1109 bp, Homo sapiens
agctggagccttccaactgccagctctttccttcccactggttacccttccctgcgcaatgagcttgctacccatccagcttgtgtcttacggtggaccaactagaaaactaaagagatttactcatgtctttgttgtctctatcagcaactaaaatttaactgttttcttcccctctaatattttctttcaaagcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatgaaaaaa

SEQ ID NO: 363670 - DNA, 1865 bp, Homo sapiens
gaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatattattt

SEQ ID NO: 363671 - DNA, 2492 bp, Homo sapiens
  misc_feature (2)..(2): n is a, c, g, or t
cngtttttgttcttctaagcaaaagatctccctctctctagccgatgctccccactcagttcatcccgggaatgggccagggaggaaggttctcatgcatcgccccgagctgccaggcgagcttcgggctccttaaattcacaggccaacagcccgcgtcctctccgcgcaggctcccggttgcccgcggtccccggcccagctccttggcctcctcctcgtcggtccgcccctggtggtcttggcgcccgctcgtccagctcggcgcgccggggaccgccggctgcccggggcagtccgcacgccctcggggatctcggctcccggatccgccgcgccggcaggagccggccgggcctggagggagcaagcggatgcgcccacgcccccggcacggggatggcgcgacagggcccgggctccggggtggggctcggcagagctcctgacagctccggggtcggcagcgcgggaggggggagctccgccgctcgccgctcattcccggctcggggctcccctccactcgctcgggcggcgcggggcccgttcgggccgcccgtcgccgcccccgccccccgcgcgcccgcccgccagcccgcctgcgccctcgctcgccccgcgcgcgttcctagggcgccacctctttgcgactagctcacttctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatattattt

SEQ ID NO: 363672 - DNA, 1556 bp, Homo sapiens
ctgctttctaataattgcctttagtgggaacagaagtctcctttcaagaagcttttaattcattttaagatttaattttatgttttctgaagaacaacaaaaaatatttctggaaaagactgctgagaagatttccctctttcagccagaagagcagagagaagattgtaaatcaaggaaaagatttcccccttcagatctaacgattacattagggctcctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatgaaaaaa

SEQ ID NO: 363673 - DNA, 1296 bp, Homo sapiens
gaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatgaaaaaa

SEQ ID NO: 363674 - DNA, 1326 bp, Homo sapiens
gaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatgaaaaaa

SEQ ID NO: 363675 - DNA, 2095 bp, Homo sapiens
ctgctttctaataattgcctttagtgggaacagaagtctcctttcaagaagcttttaattcattttaagatttaattttatgttttctgaagaacaacaaaaaatatttctggaaaagactgctgagaagatttccctctttcagccagaagagcagagagaagattgtaaatcaaggaaaagatttcccccttcagatctaacgattacattagggctcctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatattattt

SEQ ID NO: 363676 - DNA, 1397 bp, Homo sapiens
gaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacgtacagcacttctgtggggtttgaaaaaaaaaaaggaaaacaacagaagaacacatcatatgcaactaatgatctcattatttaagagtcccctgttacttctttagtcatttcctttgactctgctacagataggattataggatgatgcttcaaaggggaccttgaacctattcaccattatttgtctctttaagctggcaaacccatcattaaatagcacataaaatagcaatcatatgggataagtagtacagcttcagtaatcaatgggcagtggcactagaaaaatcttgagcacagtgaatgacctatcctgcaaacatctaatggatctctaaagggtaacaaaccctataaattctggcttactgcacatatttagtgtgttttaagataggatcctaactgtatatatttataactaatgtaaggaccctactttattgccaaaacctatttttatccattgtctcatatatataaacatgtcatatatataaacatatatatataaacatatatgtatatagtaaacattcaataaattgcaacatattatt

SEQ ID NO: 363677 - DNA, 1776 bp, Homo sapiens
agcggaaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcac

SEQ ID NO: 363678 - DNA, 1835 bp, Homo sapiens
agcggaaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgag

SEQ ID NO: 363679 - DNA, 1971 bp, Homo sapiens
agcggaaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactgtgggtataatactaagttgagatgatatcatttacgggggaaggcgctttgtgaagtaggccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaatt

SEQ ID NO: 363680 - DNA, 2784 bp, Homo sapiens
agcggaaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaaatggcattcttaaatttgcggtatctcataactgtaaatataatcagactagtacaatctgtacagctaccaatatttcatgtttcttctcatcttgagacagcacattagtttgtacaggactcagtggctaggttttgaatgattccaagatcaagggaaatgatggttattggaaaagagaaaaaataatttactttatatcgagtgaggataaaatatttccgatctttgaatcatctctatttcatcaactttcttccctggtcttccattttcatccctagagcagaaaaatctctggcatataaactaaataaaagaagaaggggagggaaagtgttttataactcataaaggagagggaaagaaaatattggtttttattggggaagtagcttagaatcccccagttaagtgcatatatctgaacttactgaacaagttacatactaggtatacacagagtggcaaaatatattccatttaggtgggtggaattaccaggggaaaaatgtaataacaccactagatgtgaaacaccaaaatcgtgaattctcaaaagcaccatacaatatgtatagtatatagttctttgaaaagaagttagaatcacaaccaataccccatgaatagctttgtggctaatgcagcaccataatttgtaatggaactaagatgatgatgacgatatttcatgaaaacagagagatgttttgagcatatttatgtggtgaggtaagaaagaaaattaatcctatagcatctgaaagacctcactgggaagttggtatggatttttgtttgatttgtgcatacaaataggtatcacaacttgatctggaaaaaataagctgtgaaaattctcaaggaataagatgaaaataaatcaattattatcatttagctctgcaaagctttccatggctaacacagtaaatttaaataaagctctctttgtctccttc

SEQ ID NO: 363681 - DNA, 2866 bp, Homo sapiens
agcggaaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttaggtaatagcattggactgagatttgtaaactttccaaccttccaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaaatggcattcttaaatttgcggtatctcataactgtaaatataatcagactagtacaatctgtacagctaccaatatttcatgtttcttctcatcttgagacagcacattagtttgtacaggactcagtggctaggttttgaatgattccaagatcaagggaaatgatggttattggaaaagagaaaaaataatttactttatatcgagtgaggataaaatatttccgatctttgaatcatctctatttcatcaactttcttccctggtcttccattttcatccctagagcagaaaaatctctggcatataaactaaataaaagaagaaggggagggaaagtgttttataactcataaaggagagggaaagaaaatattggtttttattggggaagtagcttagaatcccccagttaagtgcatatatctgaacttactgaacaagttacatactaggtatacacagagtggcaaaatatattccatttaggtgggtggaattaccaggggaaaaatgtaataacaccactagatgtgaaacaccaaaatcgtgaattctcaaaagcaccatacaatatgtatagtatatagttctttgaaaagaagttagaatcacaaccaataccccatgaatagctttgtggctaatgcagcaccataatttgtaatggaactaagatgatgatgacgatatttcatgaaaacagagagatgttttgagcatatttatgtggtgaggtaagaaagaaaattaatcctatagcatctgaaagacctcactgggaagttggtatggatttttgtttgatttgtgcatacaaataggtatcacaacttgatctggaaaaaataagctgtgaaaattctcaaggaataagatgaaaataaatcaattattatcatttagctctgcaaagctttccatggctaacacagtaaatttaaataaagctctctttgtctccttc

SEQ ID NO: 363682 - DNA, 2809 bp, Homo sapiens
agcggaaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaaatggcattcttaaatttgcggtatctcataactgtaaatataatcagactagtacaatctgtacagctaccaatatttcatgtttcttctcatcttgagacagcacattagtttgtacaggactcagtggctaggttttgaatgattccaagatcaagggaaatgatggttattggaaaagagaaaaaataatttactttatatcgagtgaggataaaatatttccgatctttgaatcatctctatttcatcaactttcttccctggtcttccattttcatccctagagcagaaaaatctctggcatataaactaaataaaagaagaaggggagggaaagtgttttataactcataaaggagagggaaagaaaatattggtttttattggggaagtagcttagaatcccccagttaagtgcatatatctgaacttactgaacaagttacatactaggtatacacagagtggcaaaatatattccatttaggtgggtggaattaccaggggaaaaatgtaataacaccactagatgtgaaacaccaaaatcgtgaattctcaaaagcaccatacaatatgtatagtatatagttctttgaaaagaagttagaatcacaaccaataccccatgaatagctttgtggctaatgcagcaccataatttgtaatggaactaagatgatgatgacgatatttcatgaaaacagagagatgttttgagcatatttatgtggtgaggtaagaaagaaaattaatcctatagcatctgaaagacctcactgggaagttggtatggatttttgtttgatttgtgcatacaaataggtatcacaacttgatctggaaaaaataagctgtgaaaattctcaaggaataagatgaaaataaatcaattattatcatttagctctgcaaagctttccatggctaacacagtaaatttaaataaagctctctttgtctccttc

SEQ ID NO: 363683 - DNA, 1393 bp, Homo sapiens
agcggaaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagactcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcac

SEQ ID NO: 363684 - DNA, 357 bp, Homo sapiens
atgtttgctcttataaagcttgtgaatcatagaagattaggacacttttaagattatacaccgagaaagaccttatcaaaatgagttactactcctttataatacacttagaattcatttataatatggtgttagttatccaacatttattgagcagtgggtgttttcaaaagctatccagaataagttaattctattcctttgttacactgtacttttaaaatatatattttctaattttgaaacattcaagctgcgcataatggttcacacctgtaatcttggctacttgagaggctgaggcaggaggatggcttgaggccaggagttcaagaccagcatgtgcaatacagtgag

SEQ ID NO: 363685 - DNA, 442 bp, Homo sapiens
ggtcttgagccagtaatctttgtactgggtttcaagaaaatctttgttgaagtttgaaccacaactttgtcatggttcttaaatgtttatactgtatttcaaagaagttgtttgaggcaaattaagtgtatgtgtgtaggttatctttttaaaaactcttcagtgcaaattgtatcttgttataaaatggacacaaatctgcaaaacaaatttacacttcatatagcattgataatcttcaggtgaacagttagtaatcatttaaaaagctcactgctgatggtagaaaatttgccttaatgaattaagtatctgggattattctttgaaaacagatgaccataatttttttttaaagcagagtgacttattttgtcttatttttaagtaaagtgtgccaattaaacctgtgtggcctatataaatgaaattaataacttca

SEQ ID NO: 363686 - DNA, 499 bp, Homo sapiens
tctatcacccagatcagattgttagcatacaggttgataaaatgcttattttacaacttaagatgtgtccattaattctcattttcactgtctgaagtaattggcaatgactaagttcttttgaatacatagattaatacagtttcataatctaatgactgtttatctactaataagcccattgctgctgtagatattatataagaacaaaggattctttgatgggaattaccttcccctccatcttcaaagagtacattcctcttttactcttaaatgacatttaacaatgtagagaccagataattagggaagatgaaataagagataattggaacagtttttttgaaatttgtcagttaaagaaggagcaaaatggattaacagtttgaaggaatagttgagtcaaaggagtgtgtgtgtgtgtgtgtgtgtgtgtgtgtctttgtatttactggagtttgattatacttgttgtatcagtggaaaagaggtagga

SEQ ID NO: 363687 - DNA, 991 bp, Homo sapiens
ggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacaccc

SEQ ID NO: 363688 - DNA, 982 bp, Homo sapiens
ggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaactttctttctaagcatggttggcgagatttccgagaacaggaatggaagattcctgggtgtggttattataccttgggggtgggtcgctccttagagaactgtggcagccagacccggtggctcttggggttcccccctcggggttcgaaggggtctcagctcccgggtggcgggctcgatcttcggcgcccccggttctcggtgctctagacacccgggcatcacgggaggggtccgggcctgcctcgcggtttctgcca

SEQ ID NO: 363689 - DNA, 942 bp, Homo sapiens
ggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggtacaaaccaaggcacataatcgtgtgtgagtgtgtgtgccagtgtgtgtacatgcatccacatatgtgtgctctcatgtaaatgattaaaaagcctggaacttatgatg

SEQ ID NO: 363690 - DNA, 1177 bp, Homo sapiens
gggggaaacagaaaatatgtttctttatatagatataaaaataattatataatttccatttgggttgagtgctgtgaaggaagagaacaacctgctatgtgagaaaagggaaaattagatgagtttgtcaggaggtgttttatttacaggcagcatttaaacagacaggttaacaccagccaggtgaggaattagaggaagcttgcctcagaaacagcttcatgtgggaaggagcttgctgtgacggaggagctaaaggaagggtattatagctagaacataggcatctaaggggatatttgtcttgatttgaagccctggagatagatcaggaggtatggagccctgtagggcatataaaagacttattttatcctaaatgtattgggaaattttcaggggcttaagcattatcttcttcatgttttaaaggaaaaacctgttaatatttgtggaatactgattacaggctaggcacaccttagccatttttcatgcaaaatgatctttggcataagataattgtgattttacagataaggaaaatgaagtttagagatcttgagtaacttgtctaaagccacataacacgtaactaacagtggtagatgctactgtttatcagaaataaaaagttaacttagcaaaggagacttttagagtgagtggccaaaaaggtcagagggatacaggtgaatgttgtgtcactaaagtcaaaataaaaaatattttaagaaggaaagataggtgagtttttctaatgtagctagagaactcatgccgatatttacaagaacttatttcttaacatcctagtagtgtaggttgtgtgttatgatagagtcatttacaaaatcacatggctgtatcttttgtagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcagtaagtaaatgatcattgggtaatagtgatttacatatgcgcataaaatgcagatatggctgcattttatgttaaaattctaaggaattttgaaaattaaaaacagtaacactatgtcatggtcaataacatgtggtaaaaataaagtttatattagaatcaaaaacactgtga

SEQ ID NO: 363691 - DNA, 450 bp, Homo sapiens
tacaatggcatgatcttgtgtgaagaacgttttataatttttatttggaagttccatattacaaatacatctcctttgtttcgataggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcagtaagtaaatgatcattgggtaatagtgatttacatatgcgcataaaatgcagatatggctgcattttatgttaaaattctaaggaattttgaaaattaaaaacagtaacactatgtcatggtcaataacatgtggtaaaaataaagtttatattagaatcaaaaacactgtga

SEQ ID NO: 363692 - DNA, 5615 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363693 - DNA, 5379 bp, Homo sapiens
gcctactactactactaaattcgcggccgcgtcgaccggctccggcgggacgggcggttctgcgtacccctctccgatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363694 - DNA, 6003 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaaggtaaaataaaacaaaacagctcacagagacacctccttcttccccctgcttctgcctccatgagtaactacctatatgacgtgctgctgctgagaccaaggaatgaatagtgccaaatcttgctgaagaatgatcttgcagaaatctgattgtgaagaaggaaatctaaaaaggccaaacaagcttcagtagagataacaccaggaaagcagttactcaaacaagactgaaagagaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtgtgccagctgtcacttttctcaggagtggtcgatggagttgactgctaccttaaccagatttgccatcgttctgaaactgccgtgtgttttctaaggacaaccaggtgttaagcctttctctttagaagaaggacagtaacctttctgttaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363695 - DNA, 5512 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacataaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363696 - DNA, 5445 bp, Homo sapiens
gcctactactactactaaattcgcggccgcgtcgacctacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaaggtaaaataaaacaaaacagctcacagagacacctccttcttccccctgcttctgcctccatgagtaactacctatatgacgtgctgctgctgagaccaaggaatgaatagtgccaaatcttgctgaagaatgatcttgcagaaatctgattgtgaagaaggaaatctaaaaaggccaaacaagcttcagtagagataacaccaggaaagcagttactcaaacaagactgaaagagaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtgtgccagctgtcacttttctcaggagtggtcgatggagttgactgctaccttaaccagatttgccatcgttctgaaactgccgtgtgttttctaaggacaaccaggtgttaagcctttctctttagaagaaggacagtaacctttctgttaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363697 - DNA, 6459 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaaggtaaaataaaacaaaacagctcacagagacacctccttcttccccctgcttctgcctccatgagtaactacctatatgacgtgctgctgctgagaccaaggaatgaatagtgccaaatcttgctgaagaatgatcttgcagaaatctgattgtgaagaaggaaatctaaaaaggccaaacaagcttcagtagagataacaccaggaaagcagttactcaaacaagactgaaagagaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtgtgccagctgtcacttttctcaggagtggtcgatggagttgactgctaccttaaccagatttgccatcgttctgaaactgccgtgtgttttctaaggacaaccaggtgttaagcctttctctttagaagaaggacagtaacctttctgttaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgcagtttcagctaataattttgagatatgtgttgattttctgattgaatcaccaagaatttcaacaagtttagaaataatttaagatgaatgaaaaatatgtcagggggagctaagcatttgctaagctcttgatgtttatatgaaaaataaagggttgtttttatattgcaactactaaagagaaaaatagcagttgaagcaaacaccaggaaaatttggctctactgaaagcccagtccttttcccctttgtctcgctgacaaagtaagactagggttatgttcatgaatagattaataaaagatgtttctttaccacacaatctgagatgagatggggtgggggagatcatgacagtgccctccaagcaatagatccagctgataatcaagcagaaaatcagacaccagaatccatttgatgatgtacggcattaaacatttccttataacaaatt

SEQ ID NO: 363698 - DNA, 3729 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgacagtcactttgctgaattcaacacatgtatattatggtggaaaaagcactagactcagggtcagccagccagaagaactgagccgacctgggatcccaccacttcctaactgttttgttaggtagttcactttctctcttcggataaatgtctccacatttcctacttcatagaattgtcagaatcaacacaatacatttaatactttgaaactcataaaatattgggagaataaacagtatgaggttatggga

SEQ ID NO: 363699 - DNA, 2083 bp, Homo sapiens
tggtcacatacctgaaagctgactttacttataaatgagtgtttgaactctctggagaactacttccttggtttttcatgggagcaaatatattgtcctgatagacaatatatgttcaggacaggcatagatattcctgttcagaacaggcatattctctccccattcaggaagttggtgggttttcagcatgtgaatattgactgtgttgtcttttctcattttttacttactacttgtttttcctcttcttccacagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363700 - DNA, 1997 bp, Homo sapiens
atcctcttgaaatctgtaagaaaagtaatgcttgtttaaagatagtgccaaatcttgctgaagaatgatcttgcagaaatctgattgtgaagaaggaaatctaaaaaggccaaacaagcttcagtagagataacaccaggaaagcagttactcaaacaagactgaaagagaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363701 - DNA, 1980 bp, Homo sapiens
tggtcacatacctgaaagctgactttacttataaatgagtgtttgaactctctggagaactacttccttggtttttcatgggagcaaatatattgtcctgatagacaatatatgttcaggacaggcatagatattcctgttcagaacaggcatattctctccccattcaggaagttggtgggttttcagcatgtgaatattgactgtgttgtcttttctcattttttacttactacttgtttttcctcttcttccacagcaatcaatcaataagaacaagtcccaggacttcagactaggctcagaatctatgacacataaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363702 - DNA, 1888 bp, Homo sapiens
ttaaacaattgctaatgatacaaaaagatgctaacaatgtttgagaggcaaactagaagataggaaattagtattttggtcttttttagttgtgtttgtatgtgtttgtgttttacacaatgtcctttattacctgtgctgttgcctgagcacactaagatttggttgtagtcagaagacattattcaagtttatttagtacattttgtgtatttttctttccagttaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363703 - DNA, 4136 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaaggtaaaataaaacaaaacagctcacagagacacctccttcttccccctgcttctgcctccatgagtaactacctatatgacgtgctgctgctgagaccaaggaatgaatagtgccaaatcttgctgaagaatgatcttgcagaaatctgattgtgaagaaggaaatctaaaaaggccaaacaagcttcagtagagataacaccaggaaagcagttactcaaacaagactgaaagagaaggttgtattccttttctttcatttcattttgtttttatgttttctggattactgaaataattaggaacatatggtatatctgtttcatttgtatattattgaacttaa

SEQ ID NO: 363704 - DNA, 3438 bp, Homo sapiens
  misc_feature (3425)..(3425): n is a, c, g, or t
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactacccaatacaggcctctccaatgacgaattgacaacagaagatctccccgacagcagcaccaaccaggctcaacggtccgaggaacctccagtcgcaaagtacaaacccaataaacccgcgaacaaagaagtaggaagtacgcagacaaggtcgcgggaccgaccacccggcgaaacaacaatatagagggcaccncccgccgcgcgcg

SEQ ID NO: 363705 - DNA, 3603 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccggtgagcccctttcttactttgacaattcttttaaatgttcagatgcttgttgtgttgatgaatatcacttatttctttagaaataaagctcataatggtcggtttttacacttgacaaattatattcta

SEQ ID NO: 363706 - DNA, 1315 bp, Homo sapiens
gggggaaacagaaaatatgtttctttatatagatataaaaataattatataatttccatttgggttgagtgctgtgaaggaagagaacaacctgctatgtgagaaaagggaaaattagatgagtttgtcaggaggtgttttatttacaggcagcatttaaacagacaggttaacaccagccaggtgaggaattagaggaagcttgcctcagaaacagcttcatgtgggaaggagcttgctgtgacggaggagctaaaggaagggtattatagctagaacataggcatctaaggggatatttgtcttgatttgaagccctggagatagatcaggaggtatggagccctgtagggcatataaaagacttattttatcctaaatgtattgggaaattttcaggggcttaagcattatcttcttcatgttttaaaggaaaaacctgttaatatttgtggaatactgattacaggctaggcacaccttagccatttttcatgcaaaatgatctttggcataagataattgtgattttacagataaggaaaatgaagtttagagatcttgagtaacttgtctaaagccacataacacgtaactaacagtggtagatgctactgtttatcagaaataaaaagttaacttagcaaaggagacttttagagtgagtggccaaaaaggtcagagggatacaggtgaatgttgtgtcactaaagtcaaaataaaaaatattttaagaaggaaagataggtgagtttttctaatgtagctagagaactcatgccgatatttacaagaacttatttcttaacatcctagtagtgtaggttgtgtgttatgatagagtcatttacaaaatcacatggctgtatcttttgtagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcaaaccaggagaaatcaatggccgtatggtaataattatccttttatgtttgaggcacactttcaaatgatagaatctttggcagcacacttgaaggaattaaaaatacagtgctcaaagactaagcaaatcagcaactaactacaacctgatccccttggaatcataaagagtctgtattggcatccacagttaatgctctatgccctctttatacctatctccctacttgagttgcactttttactactttgaccattatctcttctgtcctcacagaaaaaaataaacaggctcttgtgtaaatggtaaaa

SEQ ID NO: 363707 - DNA, 812 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcaaaccaggagaaatcaatggccgtatggtaataattatccttttatgtttgaggcacactttcaaatgatagaatctttggcagcacacttgaaggaattaaaaatacagtgctcaaagactaagcaaatcagcaactaactacaacctgatccccttggaatcataaagagtctgtattggcatccacagttaatgctctatgccctctttatacctatctccctacttgagttgcactttttactactttgaccattatctcttctgtcctcacagaaaaaaataaacaggctcttgtgtaaatggtaaaa

SEQ ID NO: 363708 - DNA, 713 bp, Homo sapiens
gagcatggtgctctgatagagaattcaatctttgcctttcctactcccgattcttatttaaatgcttttaaatcagatgtgtactgagtgtgtttatttccttttagagtgtcaacctggggctgaatcttcaacctgtcaaagccttcttaattatgtctgagaaaaggtgatcaatttgttatatttataagagccaaattatattaatagggttgtttcgagatgcataaaaatagaacaaaaatgtagaccatttaagaatccttatcaaaggttgtgctgcgtttagcattcctgtaaaaacatctattgtgaaaataaagctttcccctttcttttgagaaagagatgccaacgattttttcacctgttgcattaacagttgctgttactgcttgggcgttaggaggaagattgcttcttatgagtactctgggaaattttttaaagaatgcttgaaagaaattcaaataccaaaagtgtttttaaaccatacctagaatcttgtttatgaggaataatatttatgaagttagaatcttgtttacttatgaagaatcttgttgatttattcattgaattttgtatacaggatttttgtttgtctttttttcccttgcgataacatttggttaaggagcgaattatcaagcctctcagttttttctcccaatgatattgagccacatattggctgataatcaggttgt

SEQ ID NO: 363709 - DNA, 5530 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaaggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363710 - DNA, 6506 bp, Homo sapiens
gggggaaacagaaaatatgtttctttatatagatataaaaataattatataatttccatttgggttgagtgctgtgaaggaagagaacaacctgctatgtgagaaaagggaaaattagatgagtttgtcaggaggtgttttatttacaggcagcatttaaacagacaggttaacaccagccaggtgaggaattagaggaagcttgcctcagaaacagcttcatgtgggaaggagcttgctgtgacggaggagctaaaggaagggtattatagctagaacataggcatctaaggggatatttgtcttgatttgaagccctggagatagatcaggaggtatggagccctgtagggcatataaaagacttattttatcctaaatgtattgggaaattttcaggggcttaagcattatcttcttcatgttttaaaggaaaaacctgttaatatttgtggaatactgattacaggctaggcacaccttagccatttttcatgcaaaatgatctttggcataagataattgtgattttacagataaggaaaatgaagtttagagatcttgagtaacttgtctaaagccacataacacgtaactaacagtggtagatgctactgtttatcagaaataaaaagttaacttagcaaaggagacttttagagtgagtggccaaaaaggtcagagggatacaggtgaatgttgtgtcactaaagtcaaaataaaaaatattttaagaaggaaagataggtgagtttttctaatgtagctagagaactcatgccgatatttacaagaacttatttcttaacatcctagtagtgtaggttgtgtgttatgatagagtcatttacaaaatcacatggctgtatcttttgtagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaaggtaaaataaaacaaaacagctcacagagacacctccttcttccccctgcttctgcctccatgagtaactacctatatgacgtgctgctgctgagaccaaggaatgaatagtgccaaatcttgctgaagaatgatcttgcagaaatctgattgtgaagaaggaaatctaaaaaggccaaacaagcttcagtagagataacaccaggaaagcagttactcaaacaagactgaaagagaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtgtgccagctgtcacttttctcaggagtggtcgatggagttgactgctaccttaaccagatttgccatcgttctgaaactgccgtgtgttttctaaggacaaccaggtgttaagcctttctctttagaagaaggacagtaacctttctgttaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363711 - DNA, 5577 bp, Homo sapiens
ctcagatcgatcactcagatactttattccatgatgacaaactaagcagtgaaaaaaggaaaaagaaaaaggaagttccagtcttctctaaagctgaaacaaggtatttttgcattgataaatgtaaaatatcctcttagaaaaacactgttattttcaggttttgaatattatctgtggtttaacaaagaaaattcttacgcttttattagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaaggtaaaataaaacaaaacagctcacagagacacctccttcttccccctgcttctgcctccatgagtaactacctatatgacgtgctgctgctgagaccaaggaatgaatagtgccaaatcttgctgaagaatgatcttgcagaaatctgattgtgaagaaggaaatctaaaaaggccaaacaagcttcagtagagataacaccaggaaagcagttactcaaacaagactgaaagagaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtgtgccagctgtcacttttctcaggagtggtcgatggagttgactgctaccttaaccagatttgccatcgttctgaaactgccgtgtgttttctaaggacaaccaggtgttaagcctttctctttagaagaaggacagtaacctttctgttaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363712 - DNA, 3762 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 363713 - DNA, 3717 bp, Homo sapiens
tgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaataaagtgtcctgcacagattgagcaaggctttatggagaacagcctctactaatctggaaactccccaagggtgaaggatcatgccattcatcttcatatccctagtatttaataaaggtagaataaatactcattgaaaaaatgattaatttggaaatgaatcagtgtctggaaaaattaaccttactagtatcttcagttattctttttttataatagttttattgagctataatttatataccgtaatgcccactcttttaaaatatacagttcactggtttttaccatattcacaaagttttgcagccatccctactatctgattttagagtttttcatcacccctgaatgaagccccatatctcttagcagtcattcccaattcctacacatacacactccaaatacaa

SEQ ID NO: 363714 - DNA, 3106 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccgacttgggttgggcagcctcaaaggaagcactcaggtatggtgggcaggatcacc

SEQ ID NO: 363715 - DNA, 2866 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacaggctcttgggatagggagccagctcctcccggcgatggtggcgccgttctttgccctcttcccggtctgccttgtcatacccgcggtcccgatcccgttcc

SEQ ID NO: 363716 - DNA, 4015 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcattgagatgctaggatacttaaaagaaataatacctgtgaagagcccttgattggtgacagataagctttaggctatttgtgggcagctttgtgaaatggttaaagagcctggattctggggccaggctgtctgggttcaaatctcagctctgctaccttccagctgtgtgattttggggcacgtcacctaacctctctgtgccttagttttctcacctttaaattggggcttacagtggtgctcacttcagaatggtgttgtgagaattaaatgaatgaattcacgtgcagtgcctagaaccacactgatatattgtaagcactatgtaagtatttgctgacattgttgtggctattgattcatttgtatcaagtccctcatcacaaagatacttccatacctcagccatcttttatagatgatgatgccagggctcagacagggcaagtgctttgtccccagtcacacagccaggaaatgggattgggatgtggacttcttggcacagccatccttttgtgcacttgctgggagagacttcagaactgttttgctgcagctcagccaatggccagtggctggctccttttgctgtttttgctgtcataccccccaccctgtccctccattgtgcctgggggcccacagtgggtgctgccccccatgtgcacctgttgggggccagggtcagccctcagtgccttccacgtgccactcgcaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccgacttgggttgggcagcctcaaaggaagcactcaggtatggtgggcaggatcacc

SEQ ID NO: 363717 - DNA, 3183 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcgggtgagacagtctgcccgagcagtcgcatgggaggcggaggtcgggatcgctgggagtcgggaatgttcctcactaaactcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccgacttgggttgggcagcctcaaaggaagcactcaggtatggtgggcaggatcacc

SEQ ID NO: 363718 - DNA, 2939 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccgacttgggttgggcagcctcaaaggaagcactcaggtatggtgggcaggatcacc

SEQ ID NO: 363719 - DNA, 1769 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgc

SEQ ID NO: 363720 - DNA, 1013 bp, Homo sapiens
ttttttcgttccctcgtctcccccgtgctctgctttttcttttttccctcgtttgcgttgtggtgtgttgtttccccctctcgttttgttctttcgtcgctcccctccctctggatgtagtgggtgttggtgcgttctctgcgacactgcaggtagctccgcgcgccagctgcggtgtcttttgtttgctcctcctccgccgcctcgtggccttttttgtttgttttcgtgcctccgcgcgcgctgtcggtcgctctcgtgcttttatatatgtctcgccctctctctcttgtctgtgtgcccgcgcctctttcttctcatatacatacaacattgggccgcgcgctgtgcgctcgatctatgtcgtttcgtcctcgccccgtcgctgcggtggggcgtcgtgtggggctgcccccgtcctctctctttttctttcttttttttgtttttcttgttgttttgtctttctttttgtttttgttcttgtctctttcttttgttttttttgttttgttttcttttttttctttttttttttgtttttttttttctttggccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgc

SEQ ID NO: 363721 - DNA, 3050 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgc

SEQ ID NO: 363722 - DNA, 2516 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccgacttgggttgggcagcctcaaaggaagcactcaggtatggtgggcaggatcacc

SEQ ID NO: 363723 - DNA, 2203 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatgctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacagggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccgacttgggttgggcagcctcaaaggaagcactcaggtatggtgggcaggatcacc

SEQ ID NO: 363724 - DNA, 1179 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgc

SEQ ID NO: 363725 - DNA, 766 bp, Homo sapiens
  misc_feature (1)..(1): n is a, c, g, or t
natcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcgggtgagacagtctgcccgagcagtcgcatgggaggcggaggtcgggatcgctgggagtcgggaatgttcctcactaaagtgagagggagcatcccgtgtggaccgacgtgtgtgtgtgtgtgtgtgtgcacattgtcagtgtgttgggggcggggaagagaacattctgagagtgattgtgggatccttccgcatatggagagtagagaccattgtgagtgtggtgggtaattctttttgggaaggctaaggccaccgaaaccattctgaatatgtggagtccttccgtgtggaagagaccattctgcgggtgtgggagttcctcactgaagaagggggagactattctgagg

SEQ ID NO: 363726 - DNA, 315 bp, Homo sapiens
cccaccgactgggggaatggactacacaccgatgtagttggctttgggctccatctcgactttggtggggagagggtgccaccttctggacaaggaacagtatgagcaaaggtctggaggctgcttttgagaagtagcctcacggagtctttccaggatggtggggccgtaggggagacagaagcacctagtgccagggctgggaaccttggctcaattatctagattcttgtgaacaggaaagggacacgttaattagaaatggcatgaagggcctggagagggcaggcagggaaaactccatttaaaagccct

SEQ ID NO: 363727 - DNA, 695 bp, Homo sapiens
gtcccgcctcaagcctcgggctacttcctccaactctaatcatgccgcacccctcatggttagttgatggcctccctggcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtgtgcctggcagccccgcgagcccgaggccaggcggaggggtgtggtg

SEQ ID NO: 363728 - DNA, 3644 bp, Homo sapiens
tgatcgagctcggtccctcgttattcatcggcaccccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363729 - DNA, 4572 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaatcagtatttttaatattaaaatgg

SEQ ID NO: 363730 - DNA, 2363 bp, Homo sapiens
gtatcgtgtgtatgggaaaaagaacatcctggtgacatagtgtgtgtcttccacagatgtagaagccactggctgttccaccctcaatgtaggagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363731 - DNA, 4629 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcctggctgggggaggacgcagtggcgagcaagcgtcagggagccaggcctgaatccttgctgatgccccatcccttccacaggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363732 - DNA, 4625 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363733 - DNA, 1516 bp, Homo sapiens
gacccacgctgttcggacccacgcttccgggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363734 - DNA, 4679 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtgtgatgttgccactagccctgcccatccaaggaggcgcccatagacttacttacaaatgggaattctcgggccaggagcaaggggctgttcccaggcacccatgcaaccgtatctcccctgctgcccccacaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363735 - DNA, 1375 bp, Homo sapiens
  misc_feature (1)..(1): n is a, c, g, or t
natcagctcggtaccattaggcgcgtctgcgtgtaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363736 - DNA, 4813 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaagggtggggttgtgggtgtgagccaggactccgtggaccaaggggtggggtgtttgggggctgagtcagctgcgaacacccccacccctgcacactccccaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttgttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363737 - DNA, 1346 bp, Homo sapiens
cgaagaactaacggctaggtacgaggcctcgggtgtttaatcccttatctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363738 - DNA, 4848 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttgttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtgtgatgttgccactagccctgcccatccaaggaggcgcccatagacttacttacaaatgggaattctcgggccaggagcaaggggctgttcccaggcacccatgcaaccgtatctcccctgctgcccccacaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363739 - DNA, 4267 bp, Homo sapiens
  misc_feature (4267)..(4267): n is a, c, g, or t
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtaaatttgtaggagaacgtatggtagtcaagcttccaagactccagcggcn

SEQ ID NO: 363740 - DNA, 4711 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttgttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363741 - DNA, 3807 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaagcctcactcttccgctagggataaagcagatgtggatgccctttaagagatattaaatgcttttattttcaatattaaaaatcagtatttttaatattaaaatgg

SEQ ID NO: 363742 - DNA, 3621 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggagtggtacgcatgacgcagcagctcgcccctgagttagcagctcgcccctgagttagctgctcgcccctgagttagcagctcgctcctgagttgcagctcgcccctgagttagcagctcgcccctgagtacagctc

SEQ ID NO: 363743 - DNA, 3007 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgagccctgctgctgaggcccacctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaatcagtatttttaatattaaaatgg

SEQ ID NO: 363744 - DNA, 2549 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgccagcccgttaaaattgggggtgggcagagtggggttcccagggaactctggtgcaggggcagtgggcccaaggcaggtaggcagaacaggtgggcaggcagggagctggggttaaagggggtggatcaacgatactgtgcgggacctaaggcagaccgcagggtgaggtctaaggtggccaaagcctgggtcagcaaaggagagttctggaacgcggggcagaattcagccgggcaaggataagggtacaggctgggcatgggagctagaccagtgggctgacacaggggagctgagagtagggtggaaggggtgttgccaagagcagtgaga

SEQ ID NO: 363745 - DNA, 766 bp, Homo sapiens
  misc_feature (70)..(70): n is a, c, g, or t
ggtgggcattggcccacccagaagaagttctcaggctcctcaccttcgttgataacctgcttgctgtagnaggtgtcaaacatggtgttcaggatgtcttctgccaacttggcttcgtcagggtctgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363746 - DNA, 1974 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgccagggagctgaggcccaacggacccatatggcatcgcaacgactgccgacatggcgagaaggccgcaaagggaacttccaagccccagcgaatggaacccagggccgaaggcaagggttgccctggaaaacggggcaatggtcacagcaactggcctagccccaccaagaggacagccaaccccgcaaacccccaaccaacaagaaaggccacacgcggcacagggcaagcaaaggccacgggaccacaggaaattggaccgcaacaggtgacgagacacaccccacccga

SEQ ID NO: 363747 - DNA, 301 bp, Homo sapiens
cggtaccggttttatgggtccagtgcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363748 - DNA, 528 bp, Homo sapiens
gtacaaggacaccgtggggtcttttgtgtgaaggaaaggggtgtgagcctcgctgatgactttgcatcctgctctcaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgagccctgctgctgaggcccaccttggcctcccaagttcacccaccgactgggggaatggactacacaccgatgtagttggctttgggctccatctcgactttggtggggagagggtgccaccttctggacaaggaacagtatgagcaaaggtctggaggctgcttttgagaagtagcctcacggagtctttccaggatggtggggccgtaggggagacagaagcacctagtgccagggctgggaaccttggctcaattatctagattcttgtgaa

SEQ ID NO: 363749 - DNA, 4185 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363750 - DNA, 4544 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363751 - DNA, 4629 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgcccgtgcgtctgaggccctcagtagggggatgggaggaaggccgtgagcctggccctgacctcccacccctgcccgttccccctccagtcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363752 - DNA, 3713 bp, Homo sapiens
aggctggtacggcccgggtgttaggcatgggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363753 - DNA, 4791 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaaggtgagggctgggcatgctgttaggggccatgtggcccagtaccttcctctaagatggctcagtccccaactccagagttttgttcagggaggccaggtgggaggtgggcaggctgcaggaggtggtccaggcacaggggcagtacaaagcccctggggctgggaagcctgtgctgttcagagtggcgtctccggggtggccggaagaccaggatgaaagctgatgtggccggtgccttggcttccagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363754 - DNA, 4627 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363755 - DNA, 4713 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttgttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363756 - DNA, 4602 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgcccgtgcgtctgaggccctcagtagggggatgggaggaaggccgtgagcctggccctgacctcccacccctgcccgttccccctccagtcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaaggtgagggctgggcatgctgttaggggccatgtggcccagtaccttcctctaagatggctcagtccccaactccagagttttgttcagggaggccaggtgggaggtgggcaggctgcaggaggtggtccaggcacaggggcagtacaaagcccctggggctgggaagcctgtgctgttcagagtggcgtctccggggtggccggaagaccaggatgaaagctgatgtggccggtgccttggcttccagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcctggctgggggaggacgcagtggcgagcaagcgtcagggagccaggcctgaatccttgctgatgccccatcccttccacaggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363757 - DNA, 4630 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttgttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363758 - DNA, 4760 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtgtgatgttgccactagccctgcccatccaaggaggcgcccatagacttacttacaaatgggaattctcgggccaggagcaaggggctgttcccaggcacccatgcaaccgtatctcccctgctgcccccacaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363759 - DNA, 4762 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtgtgatgttgccactagccctgcccatccaaggaggcgcccatagacttacttacaaatgggaattctcgggccaggagcaaggggctgttcccaggcacccatgcaaccgtatctcccctgctgcccccacaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363760 - DNA, 4523 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttgtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363761 - DNA, 1332 bp, Homo sapiens
aacgaatgtgctgcggtgactctaaggatccctcataggttcgcaggactacctggaagatcgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363762 - DNA, 3779 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaagcctcactcttccgctagggataaagcagatgtggatgccctttaagagatattaaatgcttttattttcaatatta

SEQ ID NO: 363763 - DNA, 1078 bp, Homo sapiens
tctagaggatcttttggctcagtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363764 - DNA, 1089 bp, Homo sapiens
tcctgtacttcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363765 - DNA, 3536 bp, Homo sapiens
cccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggacaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtgtgcctggcagccccgcgagcccgaggccaggcggaggggtgtggtg

SEQ ID NO: 363766 - DNA, 796 bp, Homo sapiens
  misc_feature (70)..(70): n is a, c, g, or t
ggtgggcattggcccacccagaagaagttctcaggctcctcaccttcgttgataacctgcttgctgtagnaggtgtcaaacatggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363767 - DNA, 566 bp, Homo sapiens
atatttggaccaggaatgatgctggccagatgactgacttaatgtatgctagacaactggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatta

SEQ ID NO: 363768 - DNA, 1122 bp, Homo sapiens
ccacgcgtccgcactcgacaagaaagcttgctctgccatccacgctgtcaacttgcgcacaatgtagcagtcaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgagccctgctgctgaggcccacctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaatcagtatttttaatattaaaatgg

SEQ ID NO: 363769 - DNA, 965 bp, Homo sapiens
  misc_feature (64)..(65): n is a, c, g, or t
  misc_feature (76)..(76): n is a, c, g, or t
  misc_feature (79)..(79): n is a, c, g, or t
  misc_feature (81)..(81): n is a, c, g, or t
aggttgacaggttattggagtcagggtaggcgggacggtgcacaggttcaagcgacgatctatnnaccatcatccntcnantgctcacagctctcaatggagtcaattctatcgtatggctggggcctcatcagtgttaatgaaagttacaaaggggctgggcgcggtggctcatacctgtaatcccagcactttgggtggattacctgagctcaggggttcgagaccagcctgggcaacacggtgaaaccctctctgtactaaaaatacaaaaaattagccgggcatggcagcgtgtgcctgtagtcccagctactcaggaggctgaggcagaagaatttcttgaacccgggaggcagaggctgcagtgagccgagatcgcactactgcactccggcctgggcgacagagcaagactccatctccaaaaaaaaaaagaaagtgctgtcggaaggtatacatgggagagcctggaaagggtttcacccgggggatggggaatgatattaggtcctgagggatgttgggttttgacaggatcagggtagaagggaggatgttcaaggtggaggaactcagaacagcaaaggccctgaggagtacagaagtatgagagcggctctaggagcagaggagaggatcaagagttgaattttgagatgactgtttgacatccaagaagggacatcaagcaggcaaataagtatatgactctagagcacttggaagaaatcagggctggaggtgggaatctgggcatcaccaacacattgactcatactgaaaacttagggccagatgatgtcatctaggaagggtgtggcatagaagactccccacacagaggtctggggcatttcaatgcacctggagtagagcaggcagaagagtctgagaggagaggccagcgagggaggagggaaaccagaggatgtatttccaaaggaagaagaaagtgtccaggc

SEQ ID NO: 363770 - DNA, 453 bp, Homo sapiens
gctccctgagggaatgtagtatggtgttttgcagccttcacccctgaggaagcaaagggcctgtatcaaatgagctgctattttgaaagaagctttgttacttcatagtgcctggtcattgtcagattttgtgaaacagtagtaatgaatgaaaaccaatgtttattgagcacctgctgtaccattaggctgtgtgccaggcatttgacaggcattatctcagctttattggtggccacattttacaggtaagcaaactgggttgctcaaaggagttgagaacgtgtctatgtcagatagctgggatttttgcacacaggtgatcccaaagcctgcaggtgtaaccattacactacactgcgtcttctcagagatgcctcctataggaaccttgctggcctcaatgggccgtccagtctgctgaaactttgcaggccagcccccctctgccct

SEQ ID NO: 363771 - DNA, 2945 bp, Homo sapiens
  misc_feature (64)..(65): n is a, c, g, or t
  misc_feature (76)..(76): n is a, c, g, or t
  misc_feature (79)..(79): n is a, c, g, or t
  misc_feature (81)..(81): n is a, c, g, or t
  misc_feature (2189)..(2189): n is a, c, g, or t
aggttgacaggttattggagtcagggtaggcgggacggtgcacaggttcaagcgacgatctatnnaccatcatccntcnantgctcacagctctcaatggagtcaattctatcgtatggctggggcctcatcagtgttaatgaaagttacaaaggggctgggcgcggtggctcatacctgtaatcccagcactttgggtggattacctgagctcaggggttcgagaccagcctgggcaacacggtgaaaccctctctgtactaaaaatacaaaaaattagccgggcatggcagcgtgtgcctgtagtcccagctactcaggaggctgaggcagaagaatttcttgaacccgggaggcagaggctgcagtgagccgagatcgcactactgcactccggcctgggcgacagagcaagactccatctccaaaaaaaaaaagaaagtgctgtcggaaggtatacatgggagagcctggaaagggtttcacccgggggatggggaatgatattaggtcctgagggatgttgggttttgacaggatcagggtagaagggaggatgttcaaggtggaggaactcagaacagcaaaggccctgaggagtacagaagtatgagagcggctctaggagcagagggtgtggctgcagcgtggagagaggtgaggttgagaagttgaggccagaccaggcgctgtgaatgccaagctggggagtggaccaaatctgcaggcggcggtggagaattgtgtgtttactgggagatggccagaaccctcccgcagaagggttaggaggcgcttggaaaccctgcctggggacatggagttcatgagacagcagattgggcaaagctgcaacagccatattcattcagatgcaccaggggcacttactgcgccagccactggccaggtccctgatgttgtggcacgtgctacagttgtggtcctgacctttctcctgtctagttgtgatgcccgtatctattctcaggggccctgggtgaccagagtgtccttgagagtgagtctcaggctgtctgcttatctacccagagcctggggcttggcctcaaaggcgcattgcacgcgaatctcaaagacacaagtcagtgtaagccccattgctgagtgcctcccacagcactgtctgtggtcccagctgctgggatctggtcctgccttgggccaggttgctgcccaacaacgaagtgcacatgctgcccccacgcatgccaggattggatcctgtgcttctgactgctgctctctgacagccgcgtggcctgaagttggatgccaagtcagctgggtcctctcacctgggaccctcaggcccaagtgtcagtcggtggactatgggatgtttggagcctctgggaggggcctcaggcagtggttgttttggtcacccatggtagccacagctggcagagctctgctccctgtgaatgagctctgaactcagcctgacccatggcagaagctcaggggatgttggggtactggataggtggatgaggggcttgcctgcaccgcctagttctggacctgccgctgtttgtccatgtggtgttaatgggcattgcctcctgagggccttactgtcctcttgtgaggagggtgttattctctccatcttgcagttaagaaaactgaggtaggctgggcacagtagctcacacctgtaatcctagcactttgggaagccgaggagggcagttcatgcgaacctaggagttcaagaccagcctgggcaacatggcgaaaccccatctctccagaaaagtacatttagccaaatgtggtggcgtgtgctcagcctccagaagttatgaaatttccacctacttgtgaaatcctaacccacttgtgtttgttcattcccctaatggcccatatcacatcccgcctgttaaggaaagagcaggtcctcggaggctgagtacaagtagctccagctactcgggaggcttaagcaggagaatctcttgaggctgggaggctgaggctgcaagtgagccatgattgcaccactgcactccagcctggacgacagagttagactctgcttccaaaaaaaaggccaggtgtggtgtctcatgcctgtaatcccagcactttgggaggccgaggcgggtggatcacctgaggtcaggagtttgagaccagcctgaccaacatggtgaaanctcgtctctattaaaaatacaaaattagctaggcttggttgtgttcacctgtaatcccagttacttgggagggtgaggcaggaggatcgtttgaactggtgaggtggaggttgcaatgagccgagattgaaccactgcactctagcctgggtgacagagcgagagtcagtctcaaaaaaataaataaaaaataaaagacccaaaccaaaacaaaaaaagattcagagaggttgagtaatttgtccagggtcacacagctattgagaaagaaagctagggttctggtcccaggtcaacgtggttctcgttctgcttccttgctgcttcccagctccctgagggaatgtagtatggtgttttgcagccttcacccctgaggaagcaaagggcctgtatcaaatgagctgctattttgaaagaagctttgttacttcatagtgcctggtcattgtcagattttgtgaaacagtagtaatgaatgaaaaccaatgtttattgagcacctgctgtaccattaggctgtgtgccaggcatttgacaggcattatctcagctttattggtggccacattttacaggtaagcaaactgggttgctcaaaggagttgagaacgtgtctatgtcagatagctgggatttttgcacacaggtgatcccaaagcctgcaggtgtaaccattacactacactgcgtcttctcagagacacgcaatcacctctccaccatgctggtcatagaagaagggcgatccccaaa

SEQ ID NO: 363772 - DNA, 2825 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagagttatgtttgcttatgaacagtgcctgcttgtgctgggccatcaccctgatatttggtatgaagctgcccagtatcttgagcagtcaagtaaactgctcgcagaaaagggagatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaaca

SEQ ID NO: 363773 - DNA, 1911 bp, Homo sapiens
  misc_feature (904)..(904): n is a, c, g, or t
  misc_feature (1007)..(1007): n is a, c, g, or t
  misc_feature (1505)..(1505): n is a, c, g, or t
ctgggttaatttttcttttgaacagctttattgaagtataatttgtatactataagtccatccattaggtgtacagttcagtggttgttagtagtagattcaatggttgttgttactgttagattcttaagttttaaaagataacttagagtttagcaagaagtgtcattttcccacttccagatatagaggacctcctgagactcttaaaatttaatacacctctgtcaacaattcttaattcatttacatttccatagttacctgccaacctagatattgtacctctgcaagagttaaagtagctaaatatagcatagtcctggtgcctcaaaataagaaactcaattatttctaagtttgagtttgccatccttccatgttcaatgtatttaaaaaatagcagtagtctgactaatgtcagcagatatgtacttgtcattatttttaaaaggcaaatgggatacctggttcagacggcactgttataaatggttttgcattagaactgcagtatagtagaggagggctgaactagaagggaaaaaaacatggcttgcagttactgctctgctactcaatcaccaagagccagatcaaatctcttaatctttctgaagctcaagtttcctcatctataaaaatcaagtgtgataatagttaaacctttctgcataggatttttgtaaggatgaagtgagataatgcatatgaaaatattgttgcatcgtaaaagtgaattaaaaaaattaaaatctttttcaatatcctagaggacaataatacccgagttttgtttgaacgagttttaacatctggaagccttcctcctgagaagtctgggtaagccattgtgaaaagttgttgatcaggttctaaagacagctttcttacctgaattgtngtctatggggtgaatgtttgcttgagtatgagtttcaagagaaatttcctttccttctcaagttttattttacctatcagcagtacttttatacctgtttaanattatttttaaatttctgcacagtgattagaattgtttttaagagatgccatagcaatttattatcatctttcttgtatactatatatccctaaccagaaattgtggctcatgtctgtaatcccagcattttgggaggccaaggtggaaagatgactttagcccaggagtttgagaccagcctgggcaacatagtgagacccaatctatacaaaaaatgttaaaaattagctgggtgtggtggtgcatgcctgtagtcccagatactgggaggcggaggtgggagctggaggactgcttgagcccaggaggttgaggctccagtgagctgtgatcacacctctgcactccagcctgggtgacagagtgagactctgtctcaacaacaacaaaaaagatacctctctctctctccctagaaattgatattaacatgttaagagaggcattctgaaattttcacctcccttactcaaaagcaaagactcttgtaaattcnaagtttgttttacatattatgtctctgacttacggttttgtctcttgttagttttaccatacagaggaacaacactgtcaagtggtacagcggaaatattatagtaaggctttggagtcttgggttcaatatccagctagatggcaaatttcatagctataccaatcttcactttcttattaacaataatgtccaccagtgtaggattttttgtgatagccacatatctggtatataagaggcacttaatagattactttagtacaaaggtgcataatgacatttaagtagtctcagagcattaattttagctgttagaacaacgatgaggcaccagtttttccccagtgatccacgttaatgggaaacaatagcgtaatcatattagattttggagtattttcta

SEQ ID NO: 363774 - DNA, 750 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggt

SEQ ID NO: 363775 - DNA, 791 bp, Homo sapiens
  misc_feature (732)..(735): n is a, c, g, or t
  misc_feature (743)..(743): n is a, c, g, or t
  misc_feature (765)..(766): n is a, c, g, or t
  misc_feature (769)..(769): n is a, c, g, or t
  misc_feature (774)..(774): n is a, c, g, or t
cggacgcgtggggaactgatggaaacagataggaggagggagaagtttccatcagttggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaatgtctgggaggtatgtagagtccggcttatggggnnnnattatggngacggtgaatcggtgggttcannttnaagcnttaaaataaggtcggag

SEQ ID NO: 363776 - DNA, 1042 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagatcagaggtttatgaacttgatttcttgactttcctgatagctggagcgtctcaaatgattgcacacatttcttagtctcaattttaattaacctttagaaagatctatgccactcagcaattttgaggagagacaggggagatgacctaatgggaggtagagtagcaaaaccaattgagccatgaatgttaactagtgattttgatacttctggctaaattactcacttttctcaaaaagcaaataccctgctgtatttttcttacccaaaaattacagattattctttgaaaggtaatgtttggcatgctgttgacaagttatttacagagtttagatgtttattaagtaaagtaggctgagtctataaatgttaagtgatggttgttgatagatgccctatatattgggacaaaatcaaatctgagccaaggttttacctttgagattcttgactgaaattagtattgtctaatttatctagcatttatttaactttttaaatcctcataggcctggctaagaatttgagaggatttaaaagtagattttaaagtggggatgtttatgttcagagaaaaataccaatgaattactccgaagagaaacttaccgttcaaaatcagctgtaattttctttctcttgtt

SEQ ID NO: 363777 - DNA, 2715 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagaggatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaaca

SEQ ID NO: 363778 - DNA, 2921 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggtagagacgaggtctcactgtgtttcccaggctggtcttgaactcctggacttaagtgatcctcctgcctcagccttccaaactgttggattacaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagagttatgtttgcttatgaacagtgcctgcttgtgctgggccatcaccctgatatttggtatgaagctgcccagtatcttgagcagtcaagtaaactgctcgcagaaaagggagatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaaca

SEQ ID NO: 363779 - DNA, 2792 bp, Homo sapiens
  misc_feature (2733)..(2736): n is a, c, g, or t
  misc_feature (2744)..(2744): n is a, c, g, or t
  misc_feature (2766)..(2767): n is a, c, g, or t
  misc_feature (2770)..(2770): n is a, c, g, or t
  misc_feature (2775)..(2775): n is a, c, g, or t
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagagttatgtttgcttatgaacagtgcctgcttgtgctgggccatcaccctgatatttggtatgaagctgcccagtatcttgagcagtcaagtaaactgctcgcagaaaagggagatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaatgtctgggaggtatgtagagtccggcttatggggnnnnattatggngacggtgaatcggtgggttcannttnaagcnttaaaataaggtcggag

SEQ ID NO: 363780 - DNA, 2627 bp, Homo sapiens
  misc_feature (1674)..(1674): n is a, c, g, or t
  misc_feature (1777)..(1777): n is a, c, g, or t
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagagttatgtttgcttatgaacagtgcctgcttgtgctgggccatcaccctgatatttggtatgaagctgcccagtatcttgagcagtcaagtaaactgctcgcagaaaagggagatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctgggtaagccattgtgaaaagttgttgatcaggttctaaagacagctttcttacctgaattgtngtctatggggtgaatgtttgcttgagtatgagtttcaagagaaatttcctttccttctcaagttttattttacctatcagcagtacttttatacctgtttaanattatttttaaatttctgcacagtgattagaattgtttttaagagatgccatagcaatttattatcatctttcttgtatactatatatccctaaccagaaattgtggctcatgtctgtaatcccagcattttgggaggccaaggtggaaagatgactttagcccaggagtttgagaccagcctgggcaacatagtgagacccaatctatacaaaaaatgttaaaaattagctgggtgtggtggtgcatgcctgtagtcccagatactgggaggcggaggtgggagctggaggactgcttgagcccaggaggttgaggctccagtgagctgtgatcacacctctgcactccagcctgggtgacagagtgagactctgtctcaacaacaacaaaaaagatacctctctctctctccctagaaattgatattaacatgttaagagaggcattctgaaattttcacctcccttactcttacggttttgtctcttgttagttttaccatacagaggaacaacactgtcaagtggtacagcggaaatattatagtaaggctttggagtcttgggttcaatatccagctagatggcaaatttcatagctataccaatcttcactttcttattaacaataatgtccaccagtgtaggattttttgtgatagccacatatctggtatataagaggcacttaatagattactttagtacaaaggtgcataatgacatttaagtagtctcagagcattaattttagctgttagaacaacgatgaggcaccagtttttccccagtgatccacgttaatgggaaacaatagcgtaatcatattagattttggagtattttcta

SEQ ID NO: 363781 - DNA, 1216 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggtattggagtgctttagccttttatttacttgtcatgtgtcaatttattgcctcctgtgtcatttatttagaactcatttttctttttattcctacttacaaactaatatgaatgggagtatatgaaaatacagaaatgttaacttagtttttcatagagtattttgagtgtctggtgaaatgaaacattttaagagaagaattacttcacattttaattttgtgaaaatgcatggtttatcaatgtaagcacttcaataatttaacgatttttctgtaagatagtttatattatgcaagaataagctaatgtgattcaaacctatttaatcctatttaatcataattttacccaatgatactttgatatttttttcttgctttttatatcttgaaatttgaacccaggcatgtatattttaaagagtaaggaccccattcatgattatggttaggaggaaaatgtta

SEQ ID NO: 363782 - DNA, 1094 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggtattggagtgctttagccttttatttacttgtcatgtgtcaatttattgcctcctgtgtcatttatttagaactcatttttctttttattcctacttacaaactaatatgaatgggagtatatgaaaatacagaaatgttaacttagtttttcatagagtattttgagtgtctggtgaaatgaaacattttaagagaagaattacttcacattttaattttgtgaaaatgcatggtttatcaatgtaagcacttcaataatttaacgatttttctgtaagatagtttatattatgcaagaataagctaatgtgattcaaacctatttaatcctatttaatcataattttacccaatgatactttgatatttttttcttgctttttatatcttgaaatttgaacccaggcatgtatattttaaagagtaaggaccccattcatgattatggttaggaggaaaatgtta

SEQ ID NO: 363783 - DNA, 628 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggt

SEQ ID NO: 363784 - DNA, 2947 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagagttatgtttgcttatgaacagtgcctgcttgtgctgggccatcaccctgatatttggtatgaagctgcccagtatcttgagcagtcaagtaaactgctcgcagaaaagggagatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaaca

SEQ ID NO: 363785 - DNA, 2055 bp, Homo sapiens
ctgggttaatttttcttttgaacagctttattgaagtataatttgtatactataagtccatccattaggtgtacagttcagtggttgttagtagtagattcaatggttgttgttactgttagattcttaagttttaaaagataacttagagtttagcaagaagtgtcattttcccacttccagatatagaggacctcctgagactcttaaaatttaatacacctctgtcaacaattcttaattcatttacatttccatagttacctgccaacctagatattgtacctctgcaagagttaaagtagctaaatatagcatagtcctggtgcctcaaaataagaaactcaattatttctaagtttgagtttgccatccttccatgttcaatgtatttaaaaaatagcagtagtctgactaatgtcagcagatatgtacttgtcattatttttaaaaggcaaatgggatacctggttcagacggcactgttataaatggttttgcattagaactgcagtatagtagaggagggctgaactagaagggaaaaaaacatggcttgcagttactgctctgctactcaatcaccaagagccagatcaaatctcttaatctttctgaagctcaagtttcctcatctataaaaatcaagtgtgataatagttaaacctttctgcataggatttttgtaaggatgaagtgagataatgcatatgaaaatattgttgcatcgtaaaagtgaattaaaaaaattaaaatctttttcaatatcctagaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaaca

SEQ ID NO: 363786 - DNA, 2928 bp, Homo sapiens
gggcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagagttatgtttgcttatgaacagtgcctgcttgtgctgggccatcaccctgatatttggtatgaagctgcccagtatcttgagcagtcaagtaaactgctcgcagaaaagggagatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaacatcatgcttcctctgcttctttcagattttatttacaataactacttatgttatttatccaataccatttaaaaataaatgtcaggacaaggaaaaaaaaaaaa

SEQ ID NO: 363787 - DNA, 321 bp, Homo sapiens
atagtaatcacattctgtcctttttagacagtgttactataagagagacatatatgcattttacccatgtctcctccaccacttgcaatcacttgaggaattacatactgttcctctgctgtgaataaaaaagaactcagaaaacttctgttgaactgaatgcagattctccctttttactcttaacctcttcttctttagacaatcctggcctagaaatgtccagtatactgggataaggataaattatccatatttattataggtaatcattcatatcgatcaagttttaatcacctctgcacactaaaaatcagggga

SEQ ID NO: 363788 - DNA, 899 bp, Homo sapiens
  misc_feature (55)..(55): n is a, c, g, or t
  misc_feature (93)..(93): n is a, c, g, or t
agtgggggggtaagtggtgtactgggtatggggcacggccccggtgatggagcgnggggagtgccgcgcaccggtgtctcgggcgcacattangtatagtcgcggggtaggggtggtttgcgcggaggggggggcgcgagcaacaaggaaggtgggttacatgcggagagaagcggcccggtggataggtcctataggtggggagcaaggcgccagtaggtttagattttggcagaagggagaggtgggggggaagcgtaggcgtgagagtaggggcgggggggaggccggtgcgagggatcgggggggcgctaggtgagcgcatgtggttagggcgtaaagtcggtggcttatgtgtttgtttttttgtttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttttgaaaagaaacaggagacatattccaacaggtaagggaaaccggaacatcggggagaaaagaccgaaaccccgctgtgccaggggcggcgctcc

SEQ ID NO: 363789 - DNA, 2558 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363790 - DNA, 2195 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttttgaaaagaaacaggagacatattccaacaggtaagggaaaccggaacatcggggagaaaagaccgaaaccccgctgtgccaggggcggcgctcc

SEQ ID NO: 363791 - DNA, 2148 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttttgaaaagaggcagtagacaactcccaaggcggtttttacccccaatt

SEQ ID NO: 363792 - DNA, 2496 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363793 - DNA, 2546 bp, Homo sapiens
gcgggaagggtctcggcttgctgcagacggtgcacaaagccatacgccaagacgatctgaagagaacaggagttcccccgggcctgggaaggctgcctggaggaggagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363794 - DNA, 2525 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363795 - DNA, 2218 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaaaaaaaaaaaaaaaaaaaaaaaaaaaaaaaaaaaaaaaaaaaaaaaaaaaaaaaaaaaaaaaaaaaaaaaaaaaaaaaaagaaacaaaaaaaaaaagagggggggcgccggacaaaataattacttctcgcaggggagggacacgacaactaagtagcgaacacccaagttgttgtgttatgtaaaagaagaagggcgcgcacccaaagataagaggcgggtgatatataaaataaatagcagcagcaacgagggaggaagagcgagcaattatacaaaacacacgtgcaggaggaggcaaaaaacaatcaatccgctttgacggacatatcgtgtctagtaggaaagacagcaacaccaccaactcaactaggtgtcgggggggggaaacaacaactatagagaggaacaacaaaccccaccacagaagaaaatatagaaaaagacgatgcccgaagcgagcaaaataaataaaaacatacttcgacgacggatgcagctagcatgtgaccaaacaaaacaagcacacgcatatatctagcctacccgaacggaaaagaacgtagcgcccgagggacgcaatcagtcatagaacaaaagact

SEQ ID NO: 363796 - DNA, 1655 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattctaggcctaatcctagaaatttcactagcagtgatgagaac

SEQ ID NO: 363797 - DNA, 2476 bp, Homo sapiens
atgggcagtactcagacaaggactcttaggacaccccccacaggcacctgtgctctcctgagcagcttattccagaaaactcagaaaaaagggaagatatctcatgacaaaaggaagaaatcaagaagtaaagccataggctcagcagaaataggagaaccagcgagacagcagttagagtgaaagtgtatgtaggggtttgcgagactgtgcacagggataagaaatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgaagaaactcagccactgagagatgaaacagtttgccccaagtcacacattttcatccaggcactgacagtcttccactggttttattagactttggaaagtggacaagatttgataagaggaaggagcactgggaaggctttttctccatggtttctgtgttagactgtagtgcctggctccgctggtgcgagcctctgaatgtcaaccaggcatacatttgatccagtagttcccaagacttgaacggcttgatgaatttcagcatttataaggaatattcttctgtggatatcactgctaattattcattgtgcattgtatttcagagattttttttcctacattttaaactgaaacccagaatcttttacacattcgtagtttcagagccaaagcaagtcatctagttggccagccccggttcttcacactcgctcagcgtacttacaacctcagtttcaccacgataggctggtacattttattatttgtcacttatttttgttttaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363798 - DNA, 1719 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgaagaaactcagccactgagagatgaaacagtttgccccaagtcacacattttcatccaggcactgacagtcttccactggttttattagactttggaaagtggacaagatttgataagaggaaggagcactgggaaggctttttctccatggtttctgtgttagactgtagtgcctggctccgctggtgcgagcctctgaatgtcaaccaggcatacatttgatccagtagttcccaagacttgaacggcttgatgaatttcagcatttataaggaatattcttctgtggatatcactgctaattattcattgtgcattgtatttcagagattttttttcctacattttaaactgaaacccagaatcttttacacattcgtagtttcagagccaaagcaagtcatctagttggccagccccggttcttcacactcgctcagcgtacttacaacctcagtttcaccacgataggctggtacattttattatttgtcacttatttttgttttaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacggtaactccaattttactttttaccatgcttcagaagatgattgtgggagg

SEQ ID NO: 363799 - DNA, 1931 bp, Homo sapiens
tattttatgttgggtttgtattctaattttaacatgaatcattaagaacatttggattggcagcctttgagacatttaattgattctcccaataaataatttcttgagatgatagatttgggttttcttttttccttaagaacttttatggatctggtgttctcattccattagttatttcagttaaagtaaaacctgtcttacagttttctgtgttttaaaatagacatgatatcaagcagattctacacagcacgagcagacctgcccaaaccaagccttgacatgtcccagatgtgatttcctgtctccagtaatagagatgatacaattctttgaatcagctggtcttctgggataagaagatcagttcaagctttgcagagcagctccctagcaactttgtgatcaattatattctaagggaaatggattaaaaccaattgtcttaatggtcctagttaaaaatgagaggaggagtagttaatggaaagctcaatcaaaatttgcattagtcataagattgggctatctaaggacaaggttatgagtttttgatattgctaattatataattttctttcaacagtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363800 - DNA, 1515 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363801 - DNA, 359 bp, Homo sapiens
tggcaaaatacaaaatttgccgcctttgcccctcatttttttgttggtccataaaacccaagttatccctttttattttatagatgaagaaactcagccactgagagatgaaacagtttgccccaagtcacacattttcatccaggcactgacagtcttccactggttttattagactttggaaagtggacaagatttgataagaggaaggagcactgggaaggctttttctccatggtttctgtgttagactgtagtgcctggctccgctggtgcgagcctctgaatgtcaaccaggcatacatttgatccagtagttcccaagacttgaacggcttgatgaatttcagcatttataa

SEQ ID NO: 363802 - DNA, 314 bp, Homo sapiens
ccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaa

SEQ ID NO: 363803 - DNA, 703 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagcccttttggggttttttttggggtaaacaaaataaatttatatgagggggcgcc

SEQ ID NO: 363804 - DNA, 1614 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaatt

SEQ ID NO: 363805 - DNA, 2160 bp, Homo sapiens
  misc_feature (2118)..(2118): n is a, c, g, or t
  misc_feature (2126)..(2126): n is a, c, g, or t
  misc_feature (2144)..(2144): n is a, c, g, or t
  misc_feature (2148)..(2148): n is a, c, g, or t
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttttgaaaagaaacaggagnacaatctncagcagggtgagaggggnaaancctcggaaaaaa

SEQ ID NO: 363806 - DNA, 3011 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgaagaaactcagccactgagagatgaaacagtttgccccaagtcacacattttcatccaggcactgacagtcttccactggttttattagactttggaaagtggacaagatttgataagaggaaggagcactgggaaggctttttctccatggtttctgtgttagactgtagtgcctggctccgctggtgcgagcctctgaatgtcaaccaggcatacatttgatccagtagttcccaagacttgaacggcttgatgaatttcagcatttataaggaatattcttctgtggatatcactgctaattattcattgtgcattgtatttcagagattttttttcctacattttaaactgaaacccagaatcttttacacattcgtagtttcagagccaaagcaagtcatctagttggccagccccggttcttcacactcgctcagcgtacttacaacctcagtttcaccacgataggctggtacattttattatttgtcacttatttttgttttaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363807 - DNA, 2488 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363808 - DNA, 2126 bp, Homo sapiens
tgctgttttttctttcacacagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataa

SEQ ID NO: 363809 - DNA, 2067 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgaagaaactcagccactgagagatgaaacagtttgccccaagtcacacattttcatccaggcactgacagtcttccactggttttattagactttggaaagtggacaagatttgataagaggaaggagcactgggaaggctttttctccatggtttctgtgttagactgtagtgcctggctccgctggtgcgagcctctgaatgtcaaccaggcatacatttgatccagtagttcccaagacttgaacggcttgatgaatttcagcatttataaggaatattcttctgtggatatcactgctaattattcattgtgcattgtatttcagagattttttttcctacattttaaactgaaacccagaatcttttacacattcgtagtttcagagccaaagcaagtcatctagttggccagccccggttcttcacactcgctcagcgtacttacaacctcagtttcaccacgataggctggtacattttattatttgtcacttatttttgttttaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaatt

SEQ ID NO: 363810 - DNA, 1009 bp, Homo sapiens
  misc_feature (956)..(957): n is a, c, g, or t
  misc_feature (960)..(960): n is a, c, g, or t
  misc_feature (980)..(980): n is a, c, g, or t
  misc_feature (988)..(988): n is a, c, g, or t
  misc_feature (999)..(999): n is a, c, g, or t
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaannaanccagatgcggccgccccacngaaaaaanaaaaccccccngccacgaggg

SEQ ID NO: 363811 - DNA, 670 bp, Homo sapiens
cccggattggctgttcggagcggcgaggggcttggcgggagcttccagtcgctcgagagcggagagcggcaccatggccccgcgggggcggcggcggccgcggcctcacaggtctgagagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaagcgaccctggccgcctctgtgaaaggactgcatgagtcatcgaac

SEQ ID NO: 363812 - DNA, 267 bp, Homo sapiens
ctcagtcaccacaggagtgtgccttctcagttcaaaggtaaattccagtgaatgtagcatctagttaattggtcaattaggtaccattgtgggatgtgaattaccaaataggttttattctttagaataaggtgtttcttttcatctcaattttgtaaatgatgttatattacatagtcagaaatatatatattggcaaaattagttaccagtataagcttcaaaatgtcactattttcacaaattttttttttttttttttttttt

SEQ ID NO: 363813 - DNA, 535 bp, Homo sapiens
ggagtttaatgaaggcacaggtcaattaatagtctttgatagaaactgagtggctgtctatagtcacgccaccctgaaaacacctaatcgcatctgaaactaagcagttgacaagagaatgcagatacaattcaataaacctgaaaaccttacaaaatatgcaagacttcatggtagcaataaaagccttgttgaccttagtaacagccaagggtactggcaaacaagaacccagcagaccaactaacaactgtagaagacaatatcaacaaagataatggactgacaggctctttaatggagaacttgcatatgagagaattagagatcagtggaaaagaggtgaagctctcaactacttttacaaaatagttcctttataattcctgtaaaaataaaatacgggctgggcgcagtggctcacacctgttatccccagcactttggtaggccaaagccggtggatcacttaaggtcaggagttcaaaaccagcctggccaaatgatgaaatcccgtctctactaaaaatgcaaa

SEQ ID NO: 363814 - DNA, 395 bp, Homo sapiens
ttttctgttcccttaccgtgacttttagaatctgggtccaacaaattaactttatctgagaagtctgcctcctccacggcctgggcagggttaatcatatgctgttacacatctagcattcatcctggttgtaaaacagttgcatgtctgcacctccttcattacaaatttgatattcatagaaagcagtgaccttcatttttttttttaggattaacatgatttatttcattatcagtcttacaggttgctgaggttggcaaagccaggatagtaacttaaatccaaagcacttttgttgagtgacaacccgattagcaaggccctgttactgaacagagggcagtggagggagcgtgagcattagaggggaagagggcggacaggaagggagc

SEQ ID NO: 363815 - DNA, 408 bp, Homo sapiens
gatggtatttggaggtgggcctttgggagataattaggattaaataatatcatgagggttggttcctcatgatggtatttgtgtttttaagaggaagagacactggagaccactctctctcagccatctggccatctgaggacatagcactaagtcaggaggagatcttggactttggcctccagaactgggagaaatacatttctgttgttttacgcacccagtctgtggtacttttttgtggcagcccaagcagatgaggacattatccctctcccaaaaaagatacacagagtcctgcatgtgacctctttcatccgtgactgatggttatttctcttctagaggactcacactctcatttttatatcctatgaattaaatatggagatataaagttaaccactg

SEQ ID NO: 363816 - DNA, 1261 bp, Homo sapiens
ccccccaccccaccaccatgctgtctcattgctaaagaggctcgtggccggcttccaaaggcgcagtaccctttaaaaaggatttatgcatgagctcagctaaaagcaacccggttaagaagtggctcgcttgctgctctgaggaaggagcagcgtctcccctgcgcccgctttcctttctcggagttggtttgtcagctgtgtcctcgctcatccggcggccctgcccctctgcacggagcgatgcatctacacgcgggtgtgcagagtgtgaaaagcattccagctaccgggaaaaaaacaggggctgagtgaggtgtccggggaccaagtggtatcccgattacaacacaaaaataaaatcaaacagctttccttttctcttactctgatgttcatttactaacactttttgtagcaagaaacaaatgttcccaagcacagtgatctgaaaaaaaaaaaaaaaaaatcccaattgatctgccccctcctactttcaaactgtctaatccaagtgggatttgaagtcctttgctcaattgaatgcactatttgaagatagtttatttttatttttaacattgtcatttgggttttgattcagctatgattcccccataaatagaacatactcatgacttttgtataattctcattaaattattcaagactttaagaggaaagacatgccatgctaattcttttaaaaaaggaaactgccgaataacttctgtagttgtttaattagtttagggggaaaaaaaaaccttcaaaagcgtatattcaaactttgattctagttgcctttcgtctaagtcatgggaagccacgtgagtgatctttgccatctccaggagtggatggttagagggagggaataggaatccccatcagctgagggagcttaacttggctgtaagatgtggtcttggtgcagccaacacgtgggaacatgtgcctggtgctgagaaccttggaaatatgacaagatattgaggaagaacctcttctgtgacctgcagagaatcttttggaacaggccttgaatgaatccccattggacatgtgtgctttgatgcgagggaattctctctactaaaagtaaatgtgggtagtctgagggctatgataaaagaagccctgaaaccctccctccagagcaaaggggaaagggagaagcctgaagaaggactaaaaaatacttaactttggcaatcaaaaaaaaaaagcttttataaataataacttgcctgttaattaa

SEQ ID NO: 363817 - DNA, 480 bp, Homo sapiens
tgagacagagtctcactctgttgcctaggctggatggagtgcagtggcgtgatctcggttcactgcaagctctgcctcccaggttcacgccattctcctgcctcagcctcccgagtagctgagactataggtgctcaccaccacgcccggctaattttttgtatttttagtagagacggagtttcaccgtattagccaggatggtcttgatctcctgacctcgtgattcgcctgcctcagcctcccaaagtgctgggattacaggcatgagccacagtgcctggccttttgctgaatattttcaatccaagtttggttgaatccacagatgtggaaaccgcagatatggagggccaactgtatcatgtcaaatgtaattaagttttacttacacagtagtatcctgaatctaaaattaattaattagttaaagccaactagaaactagcaaactagaaaacagatttcaagattctcaac

SEQ ID NO: 363818 - DNA, 4665 bp, Homo sapiens
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgacatttcaactcctctaccagataatgaaatgtcttacaacacagtgtatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttg

SEQ ID NO: 363819 - DNA, 1944 bp, Homo sapiens
acaggaaatggctagagtttctgctgtaactctcaacctagccattcttctcatattatcctatggtagcttatctgaacctcagaaatctatccttttctaatttgaatcattttagtcaacgcagcctcagaaacggaaaccatctattgaaataatacacaaaagggacagccgtaatagcgtgtagccgttgaagcctccattccaatgaaaagacagtgggaatagatccctttggaaaccactaactaatcccagaaagaggaatgcctgtgaagttgagttgaacctgaagactagacacactgtagaacctccataggaagggtgcagagtaactgagttacttgtgatagggacaagacttacccactaccagaaacctgccccatcggtcacaaatgggattcccagagtggacactttctgtgtttagtgctgccatgggaatatcaaagaaggacactggcctttcttgagcacctatgtgtcagacactgtgcaagatgctttcaccattatgtcactatcctcccaacaccgagaggtatctttatccccactgggtgcacaggaagaggttaagtgattccctgaggcccacccagcaagtatgagagataggatctggcccttcattttctaactacaagttcaatgggctttctgctgaacacaccccacaccaccaccaccaccaccaccaccaccaccactaagccgtgtcatttctagggccatctcctctcagtcttacagccagcttgggtgtcccacctccaggcctctgcgcaaagggaatgtgggtctctctggtgatgttttcctaactgtatttgtgatgaaaacagggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggtaaggccttggaaatgcctcttcctctcgggggagagggagggaaaagtggggaggactgtgtaactgcttccagctgaattttggcagcatttaaggaacctccaatgcgctatgattgaaagtttctcgaaaaagactgcaaccccatcctctatgtgaggcttgatcctaaattattctctgaccaaggaaaaaccacacaaaacaaataatatgtcctctgagcttcctctacccgaaaaaggtgtggcttggcccgaagcagatgctggcttctgacatcccttgccactcttcttagtctcattctgtgatttttggaccgtcttttcccaccataatgtgatggaatgcagttcgggctttggcaagtgaatgcaattgaagtaaaggccctgttaatcagtgaattgagaaatagcaggacaaagtcttttctggctggtagcatctctcactgttgcatggtgctgaatttgaatagagccatgttcctcagacgtactgtaattgcccttagaggatagtagctaagacaaaaatatgttatttaatcaagcagaattgctatgcatttacaacggaaaggaagccacactaaatgaaagggactctactgtgaactgtcctaaattctcctttgctttctttgcttagctgcagacaggaaatgtcatctcttttcttgccatttgctgcttctggtaacacatcctactttagttgcagctgcaaccaaagaggcctttacttgtccaaaaaacagtcttgtaaatcagagactgaaaagcccagttatgttgctgagctgtttctccccattcagaattgtttacttctatatgttttcaagagtttcatccaagcgggagtttgagtttcaagggcagagcagccactgtgacccttggaagacagtcgc

SEQ ID NO: 363820 - DNA, 964 bp, Homo sapiens
  misc_feature (17)..(17): n is a, c, g, or t
  misc_feature (369)..(369): n is a, c, g, or t
tgagttgctccacaganactgtaactatgcagtatctttaatcaaattgagttttgatttttgtctttattgcaaaaagcaatatacaacacttaggggatgtccattttagttctttttaccagagagtagatcaaggtccctaagttggagggtaacatagaatgccagggtggcttgcacagattcagggcccagaggcagctagtgaggatggcagagattgtgcatacaaagtgtgcttttgtttgaggaaataaaaagctaagcagtctgtatggaaatgactttatgtggctcggagctgattccctgaaggatttatgactctgtattaaatgccacagccttatcttttaaaacatgctnctctaatgctgagttttcctctttttttcttttctttctttttttttttgttactgattttagaaacagtattaagcaccttgttgttttgtttctgttttcaaggaatgcagattctactaagatctccttgcaaaatgaatgcatttaattttccctatgtgtttttcctctgcaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacaggtaatcatgccctagctgtgttgacctcatcaattcttcctggcttccttctcccagggggttctcttctaataaaccatatttgcaactgactgaaaattgcattcattgtgtgtagctaagaagcacttaacacttagttttcatcaacaaattaaaagtagtttataagcactattaagttaggttttaggggaag

SEQ ID NO: 363821 - DNA, 801 bp, Homo sapiens
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaaggtacgccccgggcgcccgggcgcgccccacctcccgggcagctggactccagcctgagggtcccggggccgtggctagcgcgtgctgtcggctttgtggtgcctgcgttttattttgtcttgtgtctctgtttcccgagccttgcccggtcctgggggagcagccgtgagccctgcctgcct

SEQ ID NO: 363822 - DNA, 1143 bp, Homo sapiens
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagagaacctgtgtgctgtggaaggtccccaggctacagggtgcagagatgtccactgggcacatgctgacagatccttcaaaaaatggtacttaaagaagattagatcaacatttctgagaaaagcatctcttttgccttctcattggttcagtaaacccagttaaaggcaaagtttccagccctcagagcctgccatgggattcctgtatcattagatattgttaacattagcacttttggagtattatttcacagacatggtttcaatgttcagaaccaaaaggtggagaaatggtgtcagataaccttagagaggatcattttcttggtaatctctcctttcttaaaataaactagatattgctgacaatgtgaaatttgtgactaaccttcagtagatatgttgattttgcttttaaaataaaaaccaaggatgcttagaagtagccataagaggaaatattttgaaaatgaatgacctaaagtaatcaatggatatgtataacatttatattttaaaatga

SEQ ID NO: 363823 - DNA, 4614 bp, Homo sapiens
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttg

SEQ ID NO: 363824 - DNA, 7277 bp, Homo sapiens
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaacaaaaaaacgggggggggggcgcagaaaacagtaccccccgcggcgggggcagaacaacaataagccccaccatattagagaggaggccgcacatgagggagtgataataaaccaacgcgagcggcgcgacgtcagaacaaacaagcgtggggggagggaaaaaaacactcagcagcagtggaagtacagtggaagaaaaacaccccacctgggggcgggggggcaagatggcagaaaacccccccacggagaagaaaagacagcgtcggaaagaaaaaaacaggcggagggcattggggggggacaccacacgatttggcgcgggagtggaaagatgtgcgccaggagcgtcgagaaaaatcacgg

SEQ ID NO: 363825 - DNA, 6708 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363826 - DNA, 4288 bp, Homo sapiens
  misc_feature (4157)..(4157): n is a, c, g, or t
  misc_feature (4159)..(4159): n is a, c, g, or t
  misc_feature (4165)..(4166): n is a, c, g, or t
  misc_feature (4193)..(4193): n is a, c, g, or t
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacacncngacggnngaggtggtcacgcaacacatctttaanccgattaagcaaaaaaacgggcgcgggggaaggagcggagccgctgaaagagggcaggagaagggagagagcaaacacgccagcgcaacgcccgg

SEQ ID NO: 363827 - DNA, 5262 bp, Homo sapiens
  misc_feature (46)..(46): n is a, c, g, or t
tttatgtcataacgggcggcgttaattcaagttacatggcccgtcngtcctgacaagttaacatactccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363828 - DNA, 4162 bp, Homo sapiens
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacgcagacacgcaaccacccaggccaaagacacagagaacggtccgtacggtgcgttggcccaa

SEQ ID NO: 363829 - DNA, 6819 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363830 - DNA, 5271 bp, Homo sapiens
acaggaaatggctagagtttctgctgtaactctcaacctagccattcttctcatattatcctatggtagcttatctgaacctcagaaatctatccttttctaatttgaatcattttagtcaacgcagcctcagaaacggaaaccatctattgaaataatacacaaaagggacagccgtaatagcgtgtagccgttgaagcctccattccaatgaaaagacagtgggaatagatccctttggaaaccactaactaatcccagaaagaggaatgcctgtgaagttgagttgaacctgaagactagacacactgtagaacctccataggaagggtgcagagtaactgagttacttgtgatagggacaagacttacccactaccagaaacctgccccatcggtcacaaatgggattcccagagtggacactttctgtgtttagtgctgccatgggaatatcaaagaaggacactggcctttcttgagcacctatgtgtcagacactgtgcaagatgctttcaccattatgtcactatcctcccaacaccgagaggtatctttatccccactgggtgcacaggaagaggttaagtgattccctgaggcccacccagcaagtatgagagataggatctggcccttcattttctaactacaagttcaatgggctttctgctgaacacaccccacaccaccaccaccaccaccaccaccaccaccactaagccgtgtcatttctagggccatctcctctcagtcttacagccagcttgggtgtcccacctccaggcctctgcgcaaagggaatgtgggtctctctggtgatgttttcctaactgtatttgtgatgaaaacagggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363831 - DNA, 4277 bp, Homo sapiens
acgccatatgcgatgtctattgcaggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363832 - DNA, 1481 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaagtaagttgttttaaaactatatttgtaaaatgaaggacctttggatagttcttgaacagaatatgtattttaagtgcattaagatgatgtagctaatcataatttagagatgccaacatgcattttgtgaaatcctaattagggaataggttaggatttgatacatgttcagaaacagttatgtacttcatattttattcatcaaatatatgtgtacatatacattttgaagttttacataatttctacatttcttttataaaaatattgcctcatttatccaggaaaacatcagttttcataagtaaaattttgttccacaaatgtattctacaaaggtttcaatgttatatttccatgtcttgcagtattaagtttgatttgactgctgtggttcaggaacttgatcgttacccatttcagacagacataaagtataacctaagctttcctcataactccacatggggatattttaattaataaaacctgtgccataggagtagaagatcccttcactccattaatctatgtgaaggagtataacctgaattaaatctttgtccacctagagtgaatgttctctttatgtgttagaaaatgacttctggattttaaaaaaaaagccgtcttt

SEQ ID NO: 363833 - DNA, 1888 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacaggtaatcatgccctagctgtgttgacctcatcaattcttcctggcttccttctcccagggggttctcttctaataaaccatatttgcaactgactgaaaattgcattcattgtgtgtagctaagaagcacttaacacttagttttcatcaacaaattaaaagtagtttataagcactattaagttaggttttaggggaag

SEQ ID NO: 363834 - DNA, 1624 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363835 - DNA, 6803 bp, Homo sapiens
ggcacgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcccccctcccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363836 - DNA, 6873 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363837 - DNA, 5949 bp, Homo sapiens
  misc_feature (17)..(17): n is a, c, g, or t
  misc_feature (369)..(369): n is a, c, g, or t
tgagttgctccacaganactgtaactatgcagtatctttaatcaaattgagttttgatttttgtctttattgcaaaaagcaatatacaacacttaggggatgtccattttagttctttttaccagagagtagatcaaggtccctaagttggagggtaacatagaatgccagggtggcttgcacagattcagggcccagaggcagctagtgaggatggcagagattgtgcatacaaagtgtgcttttgtttgaggaaataaaaagctaagcagtctgtatggaaatgactttatgtggctcggagctgattccctgaaggatttatgactctgtattaaatgccacagccttatcttttaaaacatgctnctctaatgctgagttttcctctttttttcttttctttctttttttttttgttactgattttagaaacagtattaagcaccttgttgttttgtttctgttttcaaggaatgcagattctactaagatctccttgcaaaatgaatgcatttaattttccctatgtgtttttcctctgcaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363838 - DNA, 5772 bp, Homo sapiens
  misc_feature (17)..(17): n is a, c, g, or t
  misc_feature (369)..(369): n is a, c, g, or t
tgagttgctccacaganactgtaactatgcagtatctttaatcaaattgagttttgatttttgtctttattgcaaaaagcaatatacaacacttaggggatgtccattttagttctttttaccagagagtagatcaaggtccctaagttggagggtaacatagaatgccagggtggcttgcacagattcagggcccagaggcagctagtgaggatggcagagattgtgcatacaaagtgtgcttttgtttgaggaaataaaaagctaagcagtctgtatggaaatgactttatgtggctcggagctgattccctgaaggatttatgactctgtattaaatgccacagccttatcttttaaaacatgctnctctaatgctgagttttcctctttttttcttttctttctttttttttttgttactgattttagaaacagtattaagcaccttgttgttttgtttctgttttcaaggaatgcagattctactaagatctccttgcaaaatgaatgcatttaattttccctatgtgtttttcctctgcaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363839 - DNA, 6819 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagccctataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363840 - DNA, 6508 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363841 - DNA, 6295 bp, Homo sapiens
ttcttttctttcttacgaattccagacaaaaacgcccttgtactcagctcacacagaaggggatgtttaaatatagccccacacctgagctgctgattctctttctccccttccaaggctagattggcagcaaattgtaaagacaacccaattctcagcaaaacaggaaggtgaacagaagcaagaaatgtaaactttagcttaagtacattttagactttaatttaccatcattatgagggaaaagagtggcttctggaaataattttacctttgtcgtcatccatcctgtcgatcaaataatcacagttaagatggaaatatattttcaaaagagagatggcgatggagatcattttttttgttagccctcttgatgaacagatgtggcatgttgaataccaagtatttggtacgtgtatttgaagataatgaaagggcacacgaatccatctgtgttctagtctttgggccaatttaactttcagagccctcccttctgagctacatatatgcagatgctatagttctagtgtcagagagaagagctaatacaggaaagttttcataaacggtgttccttggagcacaatgccatgatttatcagaaggtgctaaatgggatccggagacatctcttgaaggctgcgctcttttcttcttgcatgtggatatcatgaacatggatatgggcttatctgccctgataagacataactcattaagcagaaaatgaactgttttgactctgtgtttgaccttgtattaatttttctttgcctatagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagcctacaacaggtcggacccacaaaagacttcagttatcatcacaaacatgagccaaaagcacatacctaccccatcccccaccccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatatta

SEQ ID NO: 363842 - DNA, 419 bp, Homo sapiens
aaaaaaatagccaggcttcatgcattgtgcctatctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaagaccattatttct

SEQ ID NO: 363843 - DNA, 419 bp, Homo sapiens
agtaaagacagggtttcaccatgttggtcaggctggtctcaaactcctgacctcaggtgatccaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaagaccattatttct

SEQ ID NO: 363844 - DNA, 406 bp, Homo sapiens
  misc_feature (31)..(31): n is a, c, g, or t
gaagtaactgcaacacaaggaacagtaagantgtcctgttcccctgccagagggataagtgaaggaaactgaatgaaggtgaactgtgaagtgcccggggccctctgtcgttatcctccgaaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaagaccattatttct

SEQ ID NO: 363845 - DNA, 425 bp, Homo sapiens
atccatttctgttattttaagcaaccaaacttgtggtagtttcaccagtctcaggaaatgaatacgaatggaaagtcaaagattccaagaaatgagtggcggggtgcggtggctcacacttgtaatcacagcatttgcgggaagattgcttgggctcaggacttggagaccttgtgtctgtgagaaacttattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaagaccattatttct

SEQ ID NO: 363846 - DNA, 477 bp, Homo sapiens
ctgacacctggctacccacaggtggaggatttcactccccaagtataaggacccttcagttgaggcagtgagagccggcctcttcagggttccctttcagtctcctgaggtttgctgagtgggattctttcagaagattaaagaggaggcaggcagagtgaatggaaaccgtctgctccgtgtcccccacccctctaggggtcttggagttcaaggctctctatcctccagccagctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccagcctgggcgacagaatgagactctgtctcaaaaaaaaaa

SEQ ID NO: 363847 - DNA, 2077 bp, Homo sapiens
caatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacaggtaagacagtaccctttcaagtacttacttgctttttaaaattttcctcttaacctcgaactccttccttagtctggccccaactacccaaagatcatccttaggtgcactgcttctggcctcttgggctatttgcttcctctgggatgtctggttaattttccatgaggatgatctagagaacctcaaaaggtagatatttatcgtgtctataattgttgcacaccgttatgcttctgtttgacttcctttgctgggctagggaaattgaggcacttgaactgataacaggatgtagggagacttaatttccctctacccatatctttcagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttagtgggagccagactataaggaataaaaggaaaaactttcttcctctctctccaagaggatatgggaagcttctgtgagtgcataggatgggggctggagtcattcttagctgtttcccttcctctgtccatatactggatcacctcaacataccctggtgtggctctaagggtaaatcagggatagggccaaggagaaaacaaccaagaactctttcctgtaataagcaggatccagtttgagaaagtttagcgaatataaaagtaaaagccatttaaaaatctatattctttttttttttttgacacagagtcttgctctgttgcccaggctggagtgcaatggcatgatctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaagaccattatttct

SEQ ID NO: 363848 - DNA, 1673 bp, Homo sapiens
atcggtatcctctgatttgggagctaagttgaattttgaattcaagagatgccacgagagagggaaagagcttcccctaagcagcctccaagggcccgagcgtggcagctccttctgcttccaaaatgctgacttgtacatacatgctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttagtgggagccagactataaggaataaaaggaaaaactttcttcctctctctccaagaggatatgggaagcttctgtgagtgcataggatgggggctggagtcattcttagctgtttcccttcctctgtccatatactggatcacctcaacataccctggtgtggctctaagggtaaatcagggatagggccaaggagaaaacaaccaagaactctttcctgtaataagcaggatccagtttgagaaagtttagcgaatataaaagtaaaagccatttaaaaatctatattctttttttttttttgacacagagtcttgctctgttgcccaggctggagtgcaatggcatgatctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaagaccattatttct

SEQ ID NO: 363849 - DNA, 1745 bp, Homo sapiens
caatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttagtgggagccagactataaggaataaaaggaaaaactttcttcctctctctccaagaggatatgggaagcttctgtgagtgcataggatgggggctggagtcattcttagctgtttcccttcctctgtccatatactggatcacctcaacataccctggtgtggctctaagggtaaatcagggatagggccaaggagaaaacaaccaagaactctttcctgtaataagcaggatccagtttgagaaagtttagcgaatataaaagtaaaagccatttaaaaatctatattctttttttttttttgacacagagtcttgctctgttgcccaggctggagtgcaatggcatgatctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaagaccattatttct

SEQ ID NO: 363850 - DNA, 3769 bp, Homo sapiens
cagcttgcctgctctcagcctaagctctctcgccaaccgtggtggctccttgcgttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaaggcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttatagttgtcttttagtatgtgatactaattaagattacttttgtattatcactatttaaaagatcctagtaatttattctttcaaataccatgttatttgttaccatcaccgatgaatacctcctaggcttatccctaaaaatgctcgctcagagaattaattataaacttgttttgtttttagtaagaaatggctaaagctcttttttttccacaatcgttagtaactgtataaaaactcatgctgctccaccagtgggccttggaaaatgcatcaagaaggccaaaccagcttgaccctggctcacagacatggtcatgaggcgatttaaatttgtgccacaatgaagagtgtgtgtacacatgcctcctagaaactacactatgggtaattaatttatttcatagaggccacccagatgccttataggttttattaatttggatatgaaagtgtaccccatttggtttcaccaggaacccaaatttagaatattgaaaagccatcaaaaagttgtgatatcaaaaatgtatgagtctcttaatatactaagcaagagtgtcacagcagtaatgataaagactagttttaatctcaagccttagaggggccctttgttgccttttgtggtgcagcctcttaagagagtggtgtttgattaacaaaaaaactgtggcccaagtggaacccttgaccttttctcagataatctgtgtatgtacacagctaacacagctctttagattccctgttaagtgactcattcacattcctttcttggatataaagtcattgctgtctttttatttttgaaatagtacaagacaaagatttttaacttaacatgaaaaattcactcttttattttggaaaaaaagttaacttttcatactaacaaacagaacaagatttaaggtaaatttcttaaacattatccagaaaaataacaagatttatagtatctacttctggtactaatatacacaaaaggccaaaaccatgcctattctgcaggtgtagcttcggtgctctcctgttcaggggcaggctcactgcccgcttcttttccttctttgcttcttttagattttttgtgtttgtgtctcctgtgactatctccttcttcactttcatggcgacgtctactattac

SEQ ID NO: 363851 - DNA, 3177 bp, Homo sapiens
accactgacatcaaggtttactgtgaaatgcagcagataaatattttacaataggaaatttaatgaaattcatacttttaagcaatcatttcagtaaaagaaattgttatagatgatgtgtatgtatgacgatagattcagaactggttagagttgaatttcagcattacattttaaaggtatttgccaaaccctaaagctcattttatttcaagtgaaaacatcatcatgaaaaaagtcacgtcacattgactaacaaggttggtaacaaatgtaatgatcaactttatcatttaacatttcacaagactttttattggtttctaaaaagcagttaatattttaaggtacggtatataaacaaaatagccatatctgatttttggcaacatgaaaatgccaatttcctttcaaaccaattcccggactacagctacaaatgtggtcaacaacgtcatcctggagtaaaattcagctcctgacacacacttctatggcaattataacatagttaacacttggcctgtacctatatgaacactgatccattgggggccactgaataaaaatttcttcaatctcatttgctattttagttgaggattctaatttacagaagagctgggcctttccttctcccattccttttataacttcctatccagtttcctgcagtttgtttttcctcctatttgaattgttcttataatctttaaacgtttctgtttccattcactttatgcgtgcatgcttctctatgacttatcaaacgtagcactgggtgtaaagtggtatttttccaaggtcaaaaaaagtatacgaattcatttattaggattaggcttaaactgctttcattgagattattcaaaggatttttgccctcattaaaattatatcaagtaaataaaaatatgacatccataagtgtgtttgttcaccaataaggatttaggtttatccaactttttgctaatacatattcaagcattgtcttaagttaaaaatatgattatcattcccagtagatgtgtaacagaacacaatagggctgtcagttttttaaggatattcaaaattatggaaaacaggttcaattacaaaaagccagctaacagcacaaaggtcaccaaggtatgatacaattttgagtgggacctatgcagtggtacttagccattaaaaatgccaacaaaaggaatggaggatgagtcacagtaagtattcccttaactgtgaaacttaaatatgcatgtacactgattacattctatttcaggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttatagttgtcttttagtatgtgatactaattaagattacttttgtattatcactatttaaaagatcctagtaatttattctttcaaataccatgttatttgttaccatcaccgatgaatacctcctaggcttatccctaaaaatgctcgctcagagaattaattataaacttgttttgtttttagtaagaaatggctaaagctcttttttttccacaatcgttagtaactgtataaaaactcatgctgctccaccagtgggccttggaaaatgcatcaagaaggccaaaccagcttgaccctggctcacagacatggtcatgaggcgatttaaatttgtgccacaatgaagagtgtgtgtacacatgcctcctagaaactacactatgggtaattaatttatttcatagaggccacccagatgccttataggttttattaatttggatatgaaagtgtaccccatttggtttcaccaggaacccaaatttagaatattgaaaagccatcaaaaagttgtgatatcaaaaatgtatgagtctcttaatatactaagcaagagtgtcacagcagtaatgataaagactagttttaatctcaagccttagaggggccctttgttgccttttgtggtgcagcctcttaagagagtggtgtttgattaacaaaaaaactgtggcccaagtggaacccttgaccttttctcagataatctgtgtatgtacacagctaacacagctctttagattccctgttaagtgactcattcacattcctttcttggatataaagtcattgctgtctttttatttttgaaatagtacaagacaaagatttttaacttaacatgaaaaattcactcttttattttggaaaaaaagttaacttttcatactaacaaacagaacaagatttaaggtaaatttcttaaacattatccagaaaaataacaagatttatagtatctacttctggtactaatatacacaaaaggccaaaaccatgcctattctgcaggtgtagcttcggtgctctcctgttcaggggcaggctcactgcccgcttcttttccttctttgcttcttttagattttttgtgtttgtgtctcctgtgactatctccttcttcactttcatggcgacgtctactattac

SEQ ID NO: 363852 - DNA, 3960 bp, Homo sapiens
caaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaaccagctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttatagttgtcttttagtatgtgatactaattaagattacttttgtattatcactatttaaaagatcctagtaatttattctttcaaataccatgttatttgttaccatcaccgatgaatacctcctaggcttatccctaaaaatgctcgctcagagaattaattataaacttgttttgtttttagtaagaaatggctaaagctcttttttttccacaatcgttagtaactgtataaaaactcatgctgctccaccagtgggccttggaaaatgcatcaagaaggccaaaccagcttgaccctggctcacagacatggtcatgaggcgatttaaatttgtgccacaatgaagagtgtgtgtacacatgcctcctagaaactacactatgggtaattaatttatttcatagaggccacccagatgccttataggttttattaatttggatatgaaagtgtaccccatttggtttcaccaggaacccaaatttagaatattgaaaagccatcaaaaagttgtgatatcaaaaatgtatgagtctcttaatatactaagcaagagtgtcacagcagtaatgataaagactagttttaatctcaagccttagaggggccctttgttgccttttgtggtgcagcctcttaagagagtggtgtttgattaacaaaaaaactgtggcccaagtggaacccttgaccttttctcagataatctgtgtatgtacacagctaacacagctctttagattccctgttaagtgactcattcacattcctttcttggatataaagtcattgctgtctttttatttttgaaatagtacaagacaaagatttttaacttaacatgaaaaattcactcttttattttggaaaaaaagttaacttttcatactaacaaacagaacaagatttaaggtaaatttcttaaacattatccagaaaaataacaagatttatagtatctacttctggtactaatatacacaaaaggccaaaaccatgcctattctgcaggtgtagcttcggtgctctcctgttcaggggcaggctcactgcccgcttcttttccttctttgcttcttttagattttttgtgtttgtgtctcctgtgactatctccttcttcactttcatggcgacgtctactattac

SEQ ID NO: 363853 - DNA, 3569 bp, Homo sapiens
accactgacatcaaggtttactgtgaaatgcagcagataaatattttacaataggaaatttaatgaaattcatacttttaagcaatcatttcagtaaaagaaattgttatagatgatgtgtatgtatgacgatagattcagaactggttagagttgaatttcagcattacattttaaaggtatttgccaaaccctaaagctcattttatttcaagtgaaaacatcatcatgaaaaaagtcacgtcacattgactaacaaggttggtaacaaatgtaatgatcaactttatcatttaacatttcacaagactttttattggtttctaaaaagcagttaatattttaaggtacggtatataaacaaaatagccatatctgatttttggcaacatgaaaatgccaatttcctttcaaaccaattcccggactacagctacaaatgtggtcaacaacgtcatcctggagtaaaattcagctcctgacacacacttctatggcaattataacatagttaacacttggcctgtacctatatgaacactgatccattgggggccactgaataaaaatttcttcaatctcatttgctattttagttgaggattctaatttacagaagagctgggcctttccttctcccattccttttataacttcctatccagtttcctgcagtttgtttttcctcctatttgaattgttcttataatctttaaacgtttctgtttccattcactttatgcgtgcatgcttctctatgacttatcaaacgtagcactgggtgtaaagtggtatttttccaaggtcaaaaaaagtatacgaattcatttattaggattaggcttaaactgctttcattgagattattcaaaggatttttgccctcattaaaattatatcaagtaaataaaaatatgacatccataagtgtgtttgttcaccaataaggatttaggtttatccaactttttgctaatacatattcaagcattgtcttaagttaaaaatatgattatcattcccagtagatgtgtaacagaacacaatagggctgtcagttttttaaggatattcaaaattatggaaaacaggttcaattacaaaaagccagctaacagcacaaaggtcaccaaggtatgatacaattttgagtgggacctatgcagtggtacttagccattaaaaatgccaacaaaaggaatggaggatgagtcacagtaagtattcccttaactgtgaaacttaaatatgcatgtacactgattacattctatttcaggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattaggtaataataatgactaatcaaaaatacttgtattaaatgttgtttcataaatgccaaagcttggccccatttgagataaggcatgtatttattatactttgtggggattaaaagtatgtacgtagcattcaacttctgagaaatccaaaataattacacatattcttggtcccatactacaactccccatacttttagcattccttctaacacaagctgaatggatagtgagtttggagaatgtaaataagaggcaagaaatatctcaattagaagttaacataattaaaatggtcagatgtagcaaaatctagcaccactaagataaacttgcattaacttcagcaacgaattaaaatactaatcatatcttgttttgtttttttttttagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttatagttgtcttttagtatgtgatactaattaagattacttttgtattatcactatttaaaagatcctagtaatttattctttcaaataccatgttatttgttaccatcaccgatgaatacctcctaggcttatccctaaaaatgctcgctcagagaattaattataaacttgttttgtttttagtaagaaatggctaaagctcttttttttccacaatcgttagtaactgtataaaaactcatgctgctccaccagtgggccttggaaaatgcatcaagaaggccaaaccagcttgaccctggctcacagacatggtcatgaggcgatttaaatttgtgccacaatgaagagtgtgtgtacacatgcctcctagaaactacactatgggtaattaatttatttcatagaggccacccagatgccttataggttttattaatttggatatgaaagtgtaccccatttggtttcaccaggaacccaaatttagaatattgaaaagccatcaaaaagttgtgatatcaaaaatgtatgagtctcttaatatactaagcaagagtgtcacagcagtaatgataaagactagttttaatctcaagccttagaggggccctttgttgccttttgtggtgcagcctcttaagagagtggtgtttgattaacaaaaaaactgtggcccaagtggaacccttgaccttttctcagataatctgtgtatgtacacagctaacacagctctttagattccctgttaagtgactcattcacattcctttcttggatataaagtcattgctgtctttttatttttgaaatagtacaagacaaagatttttaacttaacatgaaaaattcactcttttattttggaaaaaaagttaacttttcatactaacaaacagaacaagatttaaggtaaatttcttaaacattatccagaaaaataacaagatttatagtatctacttctggtactaatatacacaaaaggccaaaaccatgcctattctgcaggtgtagcttcggtgctctcctgttcaggggcaggctcactgcccgcttcttttccttctttgcttcttttagattttttgtgtttgtgtctcctgtgactatctccttcttcactttcatggcgacgtctactattac

SEQ ID NO: 363854 - DNA, 1846 bp, Homo sapiens
accactgacatcaaggtttactgtgaaatgcagcagataaatattttacaataggaaatttaatgaaattcatacttttaagcaatcatttcagtaaaagaaattgttatagatgatgtgtatgtatgacgatagattcagaactggttagagttgaatttcagcattacattttaaaggtatttgccaaaccctaaagctcattttatttcaagtgaaaacatcatcatgaaaaaagtcacgtcacattgactaacaaggttggtaacaaatgtaatgatcaactttatcatttaacatttcacaagactttttattggtttctaaaaagcagttaatattttaaggtacggtatataaacaaaatagccatatctgatttttggcaacatgaaaatgccaatttcctttcaaaccaattcccggactacagctacaaatgtggtcaacaacgtcatcctggagtaaaattcagctcctgacacacacttctatggcaattataacatagttaacacttggcctgtacctatatgaacactgatccattgggggccactgaataaaaatttcttcaatctcatttgctattttagttgaggattctaatttacagaagagctgggcctttccttctcccattccttttataacttcctatccagtttcctgcagtttgtttttcctcctatttgaattgttcttataatctttaaacgtttctgtttccattcactttatgcgtgcatgcttctctatgacttatcaaacgtagcactgggtgtaaagtggtatttttccaaggtcaaaaaaagtatacgaattcatttattaggattaggcttaaactgctttcattgagattattcaaaggatttttgccctcattaaaattatatcaagtaaataaaaatatgacatccataagtgtgtttgttcaccaataaggatttaggtttatccaactttttgctaatacatattcaagcattgtcttaagttaaaaatatgattatcattcccagtagatgtgtaacagaacacaatagggctgtcagttttttaaggatattcaaaattatggaaaacaggttcaattacaaaaagccagctaacagcacaaaggtcaccaaggtatgatacaattttgagtgggacctatgcagtggtacttagccattaaaaatgccaacaaaaggaatggaggatgagtcacagtaagtattcccttaactgtgaaacttaaatatgcatgtacactgattacattctatttcaggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaac

SEQ ID NO: 363855 - DNA, 1951 bp, Homo sapiens
tatctcctttaaatcaataaccccatactatcaatcaatcacaaaaaactcatgtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttatagttgtcttttagtatgtgatactaattaagattacttttgtattatcactatttaaaagatcctagtaatttattctttcaaataccatgttatttgttaccatcaccgatgaatacctcctaggcttatccctaaaaatgctcgctcagagaattaattataaacttgttttgtttttagtaagaaatggctaaagctcttttttttccacaatcgttagtaactgtataaaaactcatgctgctccaccagtgggccttggaaaatgcatcaagaaggccaaaccagcttgaccctggctcacagacatggtcatgaggcgatttaaatttgtgccacaatgaagagtgtgtgtacacatgcctcctagaaactacactatgggtaattaatttatttcatagaggccacccagatgccttataggttttattaatttggatatgaaagtgtaccccatttggtttcaccaggaacccaaatttagaatattgaaaagccatcaaaaagttgtgatatcaaaaatgtatgagtctcttaatatactaagcaagagtgtcacagcagtaatgataaagactagttttaatctcaagccttagaggggccctttgttgccttttgtggtgcagcctcttaagagagtggtgtttgattaacaaaaaaactgtggcccaagtggaacccttgaccttttctcagataatctgtgtatgtacacagctaacacagctctttagattccctgttaagtgactcattcacattcctttcttggatataaagtcattgctgtctttttatttttgaaatagtacaagacaaagatttttaacttaacatgaaaaattcactcttttattttggaaaaaaagttaacttttcatactaacaaacagaacaagatttaaggtaaatttcttaaacattatccagaaaaataacaagatttatagtatctacttctggtactaatatacacaaaaggccaaaaccatgcctattctgcaggtgtagcttcggtgctctcctgttcaggggcaggctcactgcccgcttcttttccttctttgcttcttttagattttttgtgtttgtgtctcctgtgactatctccttcttcactttcatggcgacgtctactattac

SEQ ID NO: 363856 - DNA, 2238 bp, Homo sapiens
accactgacatcaaggtttactgtgaaatgcagcagataaatattttacaataggaaatttaatgaaattcatacttttaagcaatcatttcagtaaaagaaattgttatagatgatgtgtatgtatgacgatagattcagaactggttagagttgaatttcagcattacattttaaaggtatttgccaaaccctaaagctcattttatttcaagtgaaaacatcatcatgaaaaaagtcacgtcacattgactaacaaggttggtaacaaatgtaatgatcaactttatcatttaacatttcacaagactttttattggtttctaaaaagcagttaatattttaaggtacggtatataaacaaaatagccatatctgatttttggcaacatgaaaatgccaatttcctttcaaaccaattcccggactacagctacaaatgtggtcaacaacgtcatcctggagtaaaattcagctcctgacacacacttctatggcaattataacatagttaacacttggcctgtacctatatgaacactgatccattgggggccactgaataaaaatttcttcaatctcatttgctattttagttgaggattctaatttacagaagagctgggcctttccttctcccattccttttataacttcctatccagtttcctgcagtttgtttttcctcctatttgaattgttcttataatctttaaacgtttctgtttccattcactttatgcgtgcatgcttctctatgacttatcaaacgtagcactgggtgtaaagtggtatttttccaaggtcaaaaaaagtatacgaattcatttattaggattaggcttaaactgctttcattgagattattcaaaggatttttgccctcattaaaattatatcaagtaaataaaaatatgacatccataagtgtgtttgttcaccaataaggatttaggtttatccaactttttgctaatacatattcaagcattgtcttaagttaaaaatatgattatcattcccagtagatgtgtaacagaacacaatagggctgtcagttttttaaggatattcaaaattatggaaaacaggttcaattacaaaaagccagctaacagcacaaaggtcaccaaggtatgatacaattttgagtgggacctatgcagtggtacttagccattaaaaatgccaacaaaaggaatggaggatgagtcacagtaagtattcccttaactgtgaaacttaaatatgcatgtacactgattacattctatttcaggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattaggtaataataatgactaatcaaaaatacttgtattaaatgttgtttcataaatgccaaagcttggccccatttgagataaggcatgtatttattatactttgtggggattaaaagtatgtacgtagcattcaacttctgagaaatccaaaataattacacatattcttggtcccatactacaactccccatacttttagcattccttctaacacaagctgaatggatagtgagtttggagaatgtaaataagaggcaagaaatatctcaattagaagttaacataattaaaatggtcagatgtagcaaaatctagcaccactaagataaacttgcattaacttcagcaacgaattaaaatactaatcatatcttgttttgtttttttttttagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaac

SEQ ID NO: 363857 - DNA, 735 bp, Homo sapiens
caaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaaccagccaggcatggcggcacgcacctgtagtcccagctacttgggaggctgaggcaggaggattgcttgagcccaggagttcaccactgcagtgaggtataattgtgacacagcactacagcctgggtgacagagcaagacccccatctctgaaaaaaataaaatacaataacattaagctaatactcg

SEQ ID NO: 363858 - DNA, 2438 bp, Homo sapiens
cagcttgcctgctctcagcctaagctctctcgccaaccgtggtggctccttgcgttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaaggcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaac

SEQ ID NO: 363859 - DNA, 3403 bp, Homo sapiens
  misc_feature (449)..(449): n is a, c, g, or t
  misc_feature (718)..(718): n is a, c, g, or t
  misc_feature (862)..(862): n is a, c, g, or t
  misc_feature (1313)..(1313): n is a, c, g, or t
  misc_feature (1367)..(1367): n is a, c, g, or t
  misc_feature (1996)..(1996): n is a, c, g, or t
  misc_feature (2202)..(2202): n is a, c, g, or t
  misc_feature (2529)..(2529): n is a, c, g, or t
  misc_feature (2706)..(2706): n is a, c, g, or t
  misc_feature (2849)..(2849): n is a, c, g, or t
  misc_feature (2976)..(2976): n is a, c, g, or t
ggatccagtcccagcatctcagcacggccttcaagcatttccacgtcctggcctggctccatggtctccccgccaatttgccaccttctccatgcatccttttctgatcccctcctcactcatcccagcaaagaaccccctcctggcctgagcatagcatttcgtggtgtgtatctcagagcatccagttaggggtgtgcaagtttactttgttactggctgatgttgtgaagtcccaagttgttggtgccgcaaacaaaaaattggacatgacacacacaaatagcaaagcagcaaaagtttattaagcacagtacgatccactatggatcaaggatgacctgcgaatggtatcagcatcactttgctatatttcatggccttttctatgtgttttttttctctttttcctcaagctgcctaagctttagccagcatgtgccttttgnttgacaggtgggttgcttagtttcttggcctctgtgtgtttacgtgtcatttccttcccatagttttaagtacatgcatgatatgcactctgtaggcatgaaccttaagtagctaattactatacggggtcattttgaggatatcttttctctgtagtacatgtgcatctttttttgcagtggtgcaatcttggctcactgcaacctcctcctccctggttcaagtgattctcctgcctcagcttcctaagcacctgagactacaggtncatgccaccacgcccggctaatttttgtatttttagtagagatggggtttcaccatgttggccaggctgatctcgaactcctgaccgcaagtgatccacccacctcggcctcccaaagcactgggattacaggcatgagccacngcacccagcctagtatatgcccatctcttaggagctgctcctaactggtttggtttggatctagccagccatggggctccttattcacttatttatcttctgtttttgctcacctgcctctttctcttgcttctgctcctactcattccttccttaatccaacctccaattccctctgctattctcctgcctcaagttcactaggctggctgcaagggtcctgagggagaggttgtgtatcgcccctgtatactccaggtccagtaaatgtttgctgactaatgattggcatttccctcaggccctgccatttctgtgggctcaggtccctactggctcaggcccctgcctccctcggcaaggccacaatgaaccggggagtcccttttaggcacttgcttctggtgctgcaactgggtaagttctcagacctggggtctcaatcagatgncgtgggaggaaaggcaaaggtggaggatggggtagagggggacagcggcgacantgagacctgactcctttcttttccacttagcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtagggttgcctggctccccatccagggaggaaaacacactatggagtgaaagcctttggtgtctgagatctggtcttagttaaactctgggatcccagagggcttgggttgacagaaactcagtggcattcttatccagagtttctctacaccaactgctggtggcccagggaaaggtggtatgtgaatttcaatattttaatatttaatattcatgaacttattttagtgagttttagaacaatcactatcacttaaaacccgtgatttcttgagtattgttgctacagacctatgtagataatactttgcacagtgactcatatgtataatcctagcactgtgggaggctgaggccggaggattgcttgagtccaggagttcaagaccagcctgaacaacatagtgagactctgtctctatgaaaaaaaanatatatatattttttttggagacaaggtctagttctatcacccaggctccagtgcagtggtgtgatctcggctcactgcaatctccacctcccaggctcaagtcatcatcccacctcagcctcccaagtagctgggactacaggcatgcaccaccatgccaggtaattttttgtacttttagtagagacagagtttcacggtgttngccaggctggtcttgatctcctgacctcgtgatttaccctccttggcctcccaaagtgctgggattacaggcgtgagtcactgtgcccggcccagaatcatttttttctacttttttttttttgaggcaaactctcgatctgttgcccaggctggagtgcagtgggcatgatcttggctcactgcaagctctgcctcccaggttcaagcaattctcctgcctcagcctcctgagtagctgggactacaggcgtgtgccaccatgcccggctaatttgcgtatttttagtagagaccggttttcatcatattggccaggctggtcttnaactcctgacctcaagtgattctcccaccttagcctcccaaagtgctgggattacaggcatgagctactgcacttggccttttctcctggttttaaaactattatatgctcattacaaaatatttggtcaatgaagaaaagaatatggaagaaaatcaaatgcatgcatacttctancactcagagatatcctctgctaacattttgattgattttcttccaatctttttttttttttttctttttgagacagggtctcactctgctgcccaggctggagtacagtggcatgaccacaacacatcacagcctcaagtgancttcccacttcagccttcccagtagctgggactacaggtgcacgccaccatgttcacctaattttttactttttgtagagatgagacttcaccatgttgctcaggctggtcttgaattcctaggctnaagtgatcttcccgctttggcctcccaaagtgctgggattataggtatgagccactgcatgtggcctattttcttccactgttgttcggcgtggagaatattatatacataattacgtaaatgatatcatactgtatataccttttttcctactccttccttaagttatatcataatgagactaccaattattagactttttttcttttttttgagacggagtctcggtctgtcacctaggctggagtgcaatggcgcgatctcagctcgctgcaacctctgcctcccaggttcaagcaattctgcctcagcctcccgagtagctgggactacagacacgtgccaccatgcccagctaacttttttatttttttattagagacagggttccaccatgctagcaggatggtctcaatctctcgacttc

SEQ ID NO: 363860 - DNA, 3074 bp, Homo sapiens
gatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccaggcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagatg

SEQ ID NO: 363861 - DNA, 1658 bp, Homo sapiens
ggccctcaaacccctgagtcctctaccaggagatcctgtatatgggaactgattttggcccagctccctctgcccactccgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccaggcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagatg

SEQ ID NO: 363862 - DNA, 2013 bp, Homo sapiens
gatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggatctgcctgcggaccagatgaatgtagcagatcccaggcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagatg

SEQ ID NO: 363863 - DNA, 2094 bp, Homo sapiens
gatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccaggcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaagacccccctattgctgctggggctccccatttgcttactttgcatttgtgcccactctccacccctgctcccctgagctgaaataaaaatacaataaacttactataaagatg

SEQ ID NO: 363864 - DNA, 569 bp, Homo sapiens
  misc_feature (38)..(38): n is a, c, g, or t
  misc_feature (46)..(46): n is a, c, g, or t
  misc_feature (54)..(54): n is a, c, g, or t
  misc_feature (62)..(62): n is a, c, g, or t
  misc_feature (65)..(65): n is a, c, g, or t
  misc_feature (72)..(72): n is a, c, g, or t
  misc_feature (221)..(221): n is a, c, g, or t
caggcgtaggtagagatataactgggggagggggaggngccgaggnagaaggangagggggnggngagtacngaggtagtgcggtgggactacgtgcgtcctaggtgctgcgtgtggtcatacgggctaagtaggacataggtcgggaggaggtagctcgggaccagcgtcgacctcgcatcgctctaggagcgtgcgtactaaggagatggagctagctnacaggggactggagggggcgtgagggtactgtgcatattaatggcggggccgtgcaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagatg

SEQ ID NO: 363865 - DNA, 3685 bp, Homo sapiens
  misc_feature (3114)..(3115): n is a, c, g, or t
  misc_feature (3119)..(3119): n is a, c, g, or t
  misc_feature (3130)..(3130): n is a, c, g, or t
  misc_feature (3133)..(3134): n is a, c, g, or t
gatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccaggcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagatgaaaaaaaaaagaaaaagaaaaaaaaaaaaaaaaaaaaaannaaanaagaaaaaaanaannaaaaaaaggggggggggggactaacaggagaaatgcccgccgggggagggcccagagtagtaaacggacagccacaggagcatgatggggtgacaagaagggggggcccacataatagggggccgacgcaaatataaaacgagagaggaagcagaggaggcgacgaagtaaaaaaaacaggcgacgaagaggggacaaacacagggccacccaggagagagacacccctggagagaaagaggaccacccccaaacaacagcgaggggaggagaacaacaacacaatggtaggcaccacaaaacacccccagccgaggaaacaagtcaaagaacacccccctcgaagcgggggcacaacactcaagcaaactacagcagccgcggcggaaaccaaccggggtgcgctaacccaccccacgacacgaaacataacaaacaggcagaacggagagtaagaaaaagaaggtagacgcgcaacaagcagcaacaacacgagcaccagcaaaacaaatctaattcacacccacgggcgggagcaaagagaagaaaca

SEQ ID NO: 363866 - DNA, 233 bp, Homo sapiens
ccaggaaaggccctgctggaaagccactggagctgtgctgcgctggaaaggccattggaggtgctagaacgcaaaggggttgcagtggggacagacctgctccccttcttctttgttcctgcagccggtttcagaagacatgtagccccatttgaggcacgaggccaggcagatcccacttgcagcctccccaggtgtctgccccgcgtttcctgcctgcggaccagatgaat

SEQ ID NO: 363867 - DNA, 1677 bp, Homo sapiens
cctgtttcatgcctcaagaggtgaggaaagagggaaagacctctcttcttgaatctgaaaaatagtctgtttttgtttttttagatggggactcgctttgttacccagtggtataatcttggctcattgcaacctccgcttcctgggctcaagctaacctcccacctcctctctgcctcacactgcagtatccactctgtcgccagcagcgaggcattatagcaggaggcttctgaattggccagaacagcagctctcaggtggggtgtctgagaacctcatttcctcattacatccctccctggtcagccatatgtgttcagcagccaaatggcaaaattcacccccagaactgtgattgtcttccctaatctggaaggcccacaagtgtggagaagcactggagaccctccagaagcagtagtgctagcagtcaggggctactctccctgccgggccccgtgcaagggcctggccaccctatcccaggtatgtgacacttggctggctgttctttattgtcctgctagtacctgttgtaaagcttcttttattaaagaagagcaggagattgaagtgtcataaattgaagagattcacaccaacacggcacatgtatacatatgtaacaaacctgcacgttgtgcacatgtaccctagaacttaaagtataataacaaaatatgtattaaaaaaataaataaataaaaaaaaaaaaaaagtacttttagcagaacatttacggtattttgtacatatgtgtgcaaagttgcttattaacatttatgtcatggtcataaagactaatttggtaacaatattcagtctccagtaaatatgtggttaattgatatgcaaattacttccaaagtacaaattaatagtctcatattacatttttgtgctttgctacctttacctcaaacaaaataatctgtaggattcttcatgcttgtttcagcaccttttgcccagctttgcttgcttcattggccagaggactgtcagcacctcatgaagccctttatatcgttctctgaggtcatttgcataatgttgtggcctatagtaggttctcaataaatacctgatggatgaatgaatgaataaggatgaggaaatgaacacggtaggtatgcctggatctggaagcagaagtggcccaaaaatggaaggaaaagaaacttggcaggaatagcaggaagaagaaagcggggaggacagtattgtgtgagtttgctagggctgtgtaacaaagtgatacaaacctgatgtctcccgcaacagacatttattgtctcacagtcttggaggccggagtgcaaaatcaagttgtgagtggagctggttccttctgtgggctgtgaggaagaatctgtcgcaggcctctctcccagcctctgctggctcgctggcagtctctggtgtcccctggcttggagtgcatcattctgatctgtcttcatcttcacgtggcgtgccctctgtgggtgtgtctgtgtccaattttccatttttgataaggataccaatcatgttggattagggcccaccctaatgacctaattttaacttaattgtctctataaataccctatctccaaataagatcactgtctgagggttaggggctaactggggaatagaactctaacataaacgttttttaggatggga

SEQ ID NO: 363868 - DNA, 1948 bp, Homo sapiens
gaaggataaatgttctttgaagtgagaaagaacttcagtctgtccggttgtcaatttggagcaagtaagttttggccttattgtttgtttcttccagagagctctctctgaggatgtgtgacattggagttattcattcattggtcaccaaatgcttgggaggtcagatggtggctcccagattgaattcagaaatagacctaagtcaacactttagcagcaagttggttcaaggggaagcaagccgctattggtcacttgactccttgccatcccttgtggcttgaatgcaggctggaaaggtgaggtgtgtccggagccagaactctggaggctctcagtcttcttcctgaattttagggttccccacagagaccatttccaagctatacgggaagaaagaggaaaccccagggttctttggcaacaagcttgctttttttctggttcttggtatgctccaccagcagcagcatcacctgggagcttgttagaaactgaattctcagctgggcaacatagtgggatcccgtctctacaaaaaagtttaaaaattagccaggcatggtggcacgcgactgtggtcccagctacttgggaggctgaggcagaaggatcgcttgagcccaggagatagaggctgcagtgagcagtgatcatgcactccagcttgagtgacagagtaagactgtctcaaaagcaaacaaacaaaaagaaatctaaattctcaggccccactccaaacctactgaatctctgggatccagctatctgtgtctgaacaagccttgcaggtgactctggtggacatgaaggattgagagccactgatccaatcattttgaattaaactgaggcccaggagcattaaggaatgacatcttggttacatttcaccaagtcttcgtgctgtgatttttctctccttgctagagctttatatttttaccttacttctaaggccacgagatcatttcttgccctcattattagtttttcctaaaattaatgattggacttaaccttccagagataatacttttcatatcacagctctttttatggcatcttgttttctgctttggtctgacctatgttcttcatcttctacctccgatttcatccttaaagctttcccatgaatttcttaaaggggagaggggaagggccctaatatattttattcttcagttcagaagtggttcaggaaattatattttaagtgcaaggtgcccctagcatctttgccacagttgaatgttttcttaagtctgtcactaaaaggtgggcttctgtgcccaattcttggcacttctgtggttcattagaaaaacactaagtttgcaggccaggcttggtggctcatgcatgtaatcccagcactttgggaggccgaggcgggcggatcacaaggtcaggagtttgagaccagcctgaccaacctggtgaaacctcgtctatactaaaaacacaaaaattagctgggcgtgttggcacgtgcctatagtcccagctactcaggaggctgaggcaggagaattgcttgaacccaggagatggaggttgcagtgagccgagatcacgccactgcactccagtctgggtgacagagcgagactccatctctaaaaaaaaaagaaaagaaaagtaaaaagaaaacatttttgtagagacaggatcttgctgtgttgttcaagctggtttcgaactcctaacctcaggcaatcatcctactttggccccccaaagtgctggaattataggtgggagccactgtgcccagcagatttcagcttctccaatctctcccttgacttcctggcaggagagctagataaactcaggtagacatgtctttcatggctacccaaagactctgtacagctagccctcaggagcctgtttaagtcaagatgtccttgcagtcccacactgatactactgagcc

SEQ ID NO: 363869 - DNA, 2123 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaata

SEQ ID NO: 363870 - DNA, 2464 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaataaaaaaaaaaaaaaaaaaaaaaaaaaaaaaaaaataaaaaaaataaaagcagtctggtaactagtgacttgcacggggtttaacacccttaaaggctggaaaaaccccaggcgctaccctacatatgccatttggcctaacatccccattttcacctgatggcttatcttacaaaaagccccccaagttcgcctttccaaattgttgcggcccccgagtggcttaatgtcatatttggcagcctcaattatttggatcacattcgtacaaactttttgaaactcctactatttctttaccaatagccctttcctacccgtttatatataccctcgccgctcc

SEQ ID NO: 363871 - DNA, 1636 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaata

SEQ ID NO: 363872 - DNA, 1011 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgaggggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaata

SEQ ID NO: 363873 - DNA, 1540 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtacgcccggcaggccacagcaggggcagatcatgtctctccctctgggcagtcctctgagggtcactcctctcctctgagctctccttcctgggctcgcatctgcagggaggagaactctgggacatcacttgtccctgaagcagtgcttggggagggcatgaaaaaagacatagcctaacctacctcccatctgtaaatccctgaacagaaattaaggaaatactctaagagacagccatcaaggggctggagatggttgcatctcagtcaacataaagtttgcctctgtgaagttagaggtcagagccctgggtggcggggaattggttgtgactagtgtgtttgttctcccatttctggggcacacagcaccacaggaaggagaggctgtgtagcaaggctaccatttcccatgttttgtcagcgtttgactatagtgagcacacacccttcctgccaaactgcagtcttgtattgccggaggacaggaaggctctgccagcattgggcttccctgacaggatccgtcgacagcctgcttacatgacatctccactcccttgggaagttttgggcttggtaacctcttgcccctgactgggcatggcctgctgagctgttctcctacagttcccgttggtcttctatttccagtcaactggagtcaacttcttctctttatctaatataaatcagaacctagtttactaagtaaacaaaccagtaaacattcagccagcaatttttattttattttgagacagagtttccctcttgttgcccaggctggagttcaatggcgcaatcccggctcactgcaaccttcgcctcccaggttcaagtgattctcctgcctcagcctcccaagtagctgggattacaggtgcctgccaccacacccagctaatttttgtatttttagtagagacagg

SEQ ID NO: 363874 - DNA, 2456 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctagagagctctctctgaggatgtgtgacattggagttattcattcattggtcaccaaatgcttgggaggtcagatggtggctcccagattgaattcagaaatagacctaagtcaacactttagcagcaagttggttcaaggggaagcaagccgctattggtcacttgactccttgccatcccttgtggcttgaatgcaggctggaaaggtgaggtgtgtccggagccagaactctggaggctctcagtcttcttcctgaattttagggttccccacagagaccatttccaagctatacgggaagaaagaggaaaccccagggttctttggcaacaagcttgctttttttctggttcttggtatgctccaccagcagcagcatcacctgggagcttgttagaaactgaattctcagctgggcaacatagtgggatcccgtctctacaaaaaagtttaaaaattagccaggcatggtggcacgcgactgtggtcccagctacttgggaggctgaggcagaaggatcgcttgagcccaggagatagaggctgcagtgagcagtgatcatgcactccagcttgagtgacagagtaagactgtctcaaaagcaaacaaacaaaaagaaatctaaattctcaggccccactccaaacctactgaatctctgggatccagctatctgtgtctgaacaagccttgcaggtgactctggtggacatgaaggattgagagccactgatccaatcattttgaattaaactgaggcccaggagcattaaggaatgacatcttggttacatttcaccaagtcttcgtgctgtgatttttctctccttgctagagctttatatttttaccttacttctaaggccacgagatcatttcttgccctcattattagtttttcctaaaattaatgattggacttaaccttccagagataatacttttcatatcacagctctttttatggcatcttgttttctgctttggtctgacctatgttcttcatcttctacctccgatttcatccttaaagctttcccatgaatttcttaaaggggagaggggaagggccctaatatattttattcttcagttcagaagtggttcaggaaattatattttaagtgcaaggtgcccctagcatctttgccacagttgaatgttttcttaagtctgtcactaaaaggtgggcttctgtgcccaattcttggcacttctgtggttcattagaaaaacactaagtttgcaggccaggcttggtggctcatgcatgtaatcccagcactttgggaggccgaggcgggcggatcacaaggtcaggagtttgagaccagcctgaccaacctggtgaaacctcgtctatactaaaaacacaaaaattagctgggcgtgttggcacgtgcctatagtcccagctactcaggaggctgaggcaggagaattgcttgaacccaggagatggaggttgcagtgagccgagatcacgccactgcactccagtctgggtgacagagcgagactccatctctaaaaaaaaaagaaaagaaaagtaaaaagaaaacatttttgtagagacaggatcttgctgtgttgttcaagctggtttcgaactcctaacctcaggcaatcatcctactttggccccccaaagtgctggaattataggtgggagccactgtgcccagcagatttcagcttctccaatctctcccttgacttcctggcaggagagctagataaactcaggtagacatgtctttcatggctacccaaagactctgtacagctagccctcaggagcctgtttaagtcaagatgtccttgcagtcccacactgatactactgagcc

SEQ ID NO: 363875 - DNA, 1777 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaata

SEQ ID NO: 363876 - DNA, 2113 bp, Homo sapiens
cttagggccctctctggagttatgactaagagtagaagttatgaatagtccatcccctagaaaataggttagatttccttgccccaagctgatgacctaataaatgcatgacaacatagagacacgtccatgaagtgtgcccacctctctagcccacctgtgttattcagggttctccagagaaacagaaccaatagggtgtttaagacagagatttatttgaagaaattggggccaggcatggtggctcacacctgtaatctcagcactttgggaggccaaggcaggaggatcacttgggccctgcctgggcaacagaggaggaccccatctctacaaaaaaaaaattttaaattagccaggcgtggtggtacacacctgtggtcccacttgggaggccaagatggaggatcgcttgaggccaggagattgagactagcctgggcagcatagcaagaccccacctctacaaaaaagaaaaaaaaattagttcgtgcagttgtaaggcagagaagtccaaaatcctcagggcaggcggacatgctggagattcccccttgaaactttgagatttcctgttgtgtcctgttgttaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaata

SEQ ID NO: 363877 - DNA, 3100 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtacgcccggcaggccacagcaggggcagatcatgtctctccctctgggcagtcctctgagggtcactcctctcctctgagctctccttcctgggctcgcatctgcagggaggagaactctgggacatcacttgtccctgaagcagtgcttggggagggcatgaaaaaagacatagcctaacctacctcccatctgtaaatccctgaacagaaattaaggaaatactctaagagacagccatcaaggggctggagatggttgcatctcagtcaacataaagtttgcctctgtgaagttagaggtcagagccctgggtggcggggaattggttgtgactagtgtgtttgttctcccatttctggggcacacagcaccacaggaaggagaggctgtgtagcaaggctaccatttcccatgttttgtcagcgtttgactatagtgagcacacacccttcctgccaaactgcagtcttgtattgccggaggacaggaaggctctgccagcattgggcttccctgacaggatccgtcgacagcctgcttacatgacatctccactcccttgggaagttttgggcttggtaacctcttgcccctgactgggcatggcctgctgagctgttctcctacagttcccgttggtcttctatttccagtcaactggagtcaacttcttctctttatctaatataaatcagaacctagtttactaagtaaacaaaccagtaaacattcagccagcaatttttattttattttgagacagagtttccctcttgttgcaatgagccaagattataccactgggtaacaaagcgagtccccatctaaaaaaacaaaaacagactatttttcagattcaagaagagaggtctttccctctttcctcacctcttgaggcatgaaacaggaattccttatcctagttttatcaccaccaaactcctagcagtcataaaagtcctttttcctctaaacccacctcctctctgcctcacactgcagtatccactctgtcgccagcagcgaggcattatagcaggaggcttctgaattggccagaacagcagctctcaggtggggtgtctgagaacctcatttcctcattacatccctccctggtcagccatatgtgttcagcagccaaatggcaaaattcacccccagaactgtgattgtcttccctaatctggaaggcccacaagtgtggagaagcactggagaccctccagaagcagtagtgctagcagtcaggggctactctccctgccgggccccgtgcaagggcctggccaccctatcccaggtatgtgacacttggctggctgttctttattgtcctgctagtacctgttgtaaagcttcttttattaaagaagagcaggagattgaagtgtcataaattgaagagattcacaccaacacggcacatgtatacatatgtaacaaacctgcacgttgtgcacatgtaccctagaacttaaagtataataacaaaatatgtattaaaaaaataaataaataaaaaaaaaaaaaaagtacttttagcagaacatttacggtattttgtacatatgtgtgcaaagttgcttattaacatttatgtcatggtcataaagactaatttggtaacaatattcagtctccagtaaatatgtggttaattgatatgcaaattacttccaaagtacaaattaatagtctcatattacatttttgtgctttgctacctttacctcaaacaaaataatctgtaggattcttcatgcttgtttcagcaccttttgcccagctttgcttgcttcattggccagaggactgtcagcacctcatgaagccctttatatcgttctctgaggtcatttgcataatgttgtggcctatagtaggttctcaataaatacctgatggatgaatgaatgaataaggatgaggaaatgaacacggtaggtatgcctggatctggaagcagaagtggcccaaaaatggaaggaaaagaaacttggcaggaatagcaggaagaagaaagcggggaggacagtattgtgtgagtttgctagggctgtgtaacaaagtgatacaaacctgatgtctcccgcaacagacatttattgtctcacagtcttggaggccggagtgcaaaatcaagttgtgagtggagctggttccttctgtgggctgtgaggaagaatctgtcgcaggcctctctcccagcctctgctggctcgctggcagtctctggtgtcccctggcttggagtgcatcattctgatctgtcttcatcttcacgtggcgtgccctctgtgggtgtgtctgtgtccaattttccatttttgataaggataccaatcatgttggattagggcccaccctaatgacctaattttaacttaattgtctctataaataccctatctccaaataagatcactgtctgagggttaggggctaactggggaatagaactctaacataaacgttttttaggatggga

SEQ ID NO: 363878 - DNA, 1156 bp, Homo sapiens
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaata

SEQ ID NO: 363879 - DNA, 975 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctgggaaaaaaaaataaaaaaaaaacacaacaaagggggccgggcgcgcgcactaaaaagtacccccttgagcgcgcccacggtataacgcgacccccggttttcttgtcacaagggggcccatattaggaagacccgaatatataagcatagggccactgcccgcgagtatacaccacgcttggacacgggcgaaaccggtgcacacccgggggacactggagcaagggacccatactcgcggggggcgaccaaacggggacacaaacccacaagagatataacgccagacgcaactataag

SEQ ID NO: 363880 - DNA, 456 bp, Homo sapiens
ctactactaaattcggcggcgctcgactgtggagatctccctgacatgcaagaacagggtaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgtgatgtttattgaaggaagcaagggcagggctggggtgccgccctcaggcctgggtcgacg

SEQ ID NO: 363881 - DNA, 1522 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363882 - DNA, 2041 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaaagagaagaggcgatggcggcgatggcatctctcggcgccctggcgctgctcctgctgtccagcctctcccgctgctcagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaggagcgcatgggtccccagctgatccgtgctatgaggcagggccgggccatcctgccctcagaccgggatactcgagctggcttacccaggcatctctccctcttccccgcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363883 - DNA, 871 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363884 - DNA, 1727 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaaccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363885 - DNA, 1139 bp, Homo sapiens
  misc_feature (915)..(916): n is a, c, g, or t
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctgggaaaaaaaacaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttaaatttccctgggggggcccaaatttccccccccccccttttttttaaaaaaggggccccttttggggggggttttaaaaacgaggcccggccccggtttttaaaaccnngggacgggaaaaactttttttttgggatttttggaaagaacccttcttttgggggggggaataattgggaaaccctcctcaaaaagtttaaagcctttagggaaattaaaaattttgaagggtttattgggaaaactacctcttatccctctcggggggagagattcgctctccgggaattatatataaaaattttcaccaaggcacgagggatctacttttg

SEQ ID NO: 363886 - DNA, 833 bp, Homo sapiens
  misc_feature (693)..(693): n is a, c, g, or t
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggggcccgggaaaaaacanacaccaaaaaataatagaagacaaaaaccagaacatacacaaactataatccaataaacaaaaaggggggggggccaaaaaatatcccccagggagggccacccaatacgcacacgccttttttgtaccacagggcccca

SEQ ID NO: 363887 - DNA, 1048 bp, Homo sapiens
  misc_feature (824)..(825): n is a, c, g, or t
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctgggaaaaaaaaaaaaaaaaaaaaaaaggggggggcctttttaaatttccctgggggggcccaaatttccccccccccccttttttttaaaaaaggggccccttttggggggggttttaaaaacgaggcccggccccggtttttaaaaccnngggacgggaaaaactttttttttgggatttttggaaagaacccttcttttgggggggggaataattgggaaaccctcctcaaaaagtttaaagcctttagggaaattaaaaattttgaagggtttattgggaaaactacctcttatccctctcggggggagagattcgctctccgggaattatatataaaaattttcaccaaggcacgagggatctacttttg

SEQ ID NO: 363888 - DNA, 1427 bp, Homo sapiens
  misc_feature (1287)..(1287): n is a, c, g, or t
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaaagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggggcccgggaaaaaacanacaccaaaaaataatagaagacaaaaaccagaacatacacaaactataatccaataaacaaaaaggggggggggccaaaaaatatcccccagggagggccacccaatacgcacacgccttttttgtaccacagggcccca

SEQ ID NO: 363889 - DNA, 869 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcgggtgagtggcctggtccctcctcctttttggggttgttgggctgagtgaaggttatcctctccacagccccagctctgctgctgggccgtgattggccagcatgtcttggttcccctggcggaaggtgaccagggctggctggtctgctcacctgtactcccctgagctggcttgtgatctcctttttttcagggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363890 - DNA, 461 bp, Homo sapiens
gcggccgcctactactactactgctcgaattcaagcttctaacgatgtacgggaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363891 - DNA, 630 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363892 - DNA, 1372 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaggagcgcatgggtccccagctgatccgtgctatgaggcagggccgggccatcctgccctcagaccgggatactcgagctggcttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363893 - DNA, 2325 bp, Homo sapiens
  misc_feature (2101)..(2102): n is a, c, g, or t
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctgggaaaaaaaaaaaaaaaaaaaaaaaggggggggcctttttaaatttccctgggggggcccaaatttccccccccccccttttttttaaaaaaggggccccttttggggggggttttaaaaacgaggcccggccccggtttttaaaaccnngggacgggaaaaactttttttttgggatttttggaaagaacccttcttttgggggggggaataattgggaaaccctcctcaaaaagtttaaagcctttagggaaattaaaaattttgaagggtttattgggaaaactacctcttatccctctcggggggagagattcgctctccgggaattatatataaaaattttcaccaaggcacgagggatctacttttg

SEQ ID NO: 363894 - DNA, 648 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctgggaaaaaaaaaaagtggtgggtttttttttttttttttttttttttta

SEQ ID NO: 363895 - DNA, 1827 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaaggtgcgcagggccttgagtgccaggccgaagactggcttttccggagggccctgccttacccttaccagagttttcggcagagccgaccaggggtcccgtcgatttgcattcgtgaggggctgaggtctgaactccagagtgtgtttaggaggtggctgcagcagccagccccgggcccgggggccaggactggacaggggcggctttctccacattcccttttctgccgtccttcaggccagtagccttgctgcctgcaacgttttggcagcctaactggcctccctttccgcacactcctcatctgcccctcaggaattccctgaactatagtcagggacgtatccagaggacaagcctggccataaaacccttcgggggctcccctgcgccacaggaa

SEQ ID NO: 363896 - DNA, 762 bp, Homo sapiens
gccacgcagtggctcagtgtgggagcatggcctagaggtcaaacctcttacccatcagggccaggtgctggctggcagctgcttcagatggtttccagcccacctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcggccaatcaaccccggcgcgaagccctttccccgcccctggtggggcccctagccaatcggactccagactgcttcgggtgcggctaccccaccgctcccctgcgaccgctgccgcggtcccgtggctctttccctgctcacctcccagggacggcagagaagggctggcccga

SEQ ID NO: 363897 - DNA, 677 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363898 - DNA, 435 bp, Homo sapiens
ccgtgggctctggctgccggagtgctgcagtgtcggcactggtggtcagggtggcccctccgtgtccactctgcccacactctgctcaacacccaacccagggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363899 - DNA, 1271 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaaagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363900 - DNA, 1447 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaggagcgcatgggtccccagctgatccgtgctatgaggcagggccgggccatcctgccctcagaccgggatactcgagctggcttacccaggcatctctccctcttccccgcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363901 - DNA, 2292 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaggagcgcatgggtccccagctgatccgtgctatgaggcagggccgggccatcctgccctcagaccgggatactcgagctggcttacccaggcatctctccctcttccccgcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363902 - DNA, 2449 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaaggtgcgcagggccttgagtgccaggccgaagactggcttttccggagggccctgccttacccttaccagagttttcggcagagccgaccaggggtcccgtcgatttgcattcgtgaggggctgaggtctgaactccagagtgtgtttaggaggtggctgcagcagccagccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaggagcgcatgggtccccagctgatccgtgctatgaggcagggccgggccatcctgccctcagaccgggatactcgagctggcttacccaggcatctctccctcttccccgcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363903 - DNA, 1992 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaaccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363904 - DNA, 1664 bp, Homo sapiens
cctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcgccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcgagagaagaggcgatggcggcgatggcatctctcggcgccctggcgctgctcctgctgtccagcctctcccgctgctcagggatctgcctcctgtggtccagacccagagccttctctgacgtcctctgctgaagccatcgttctgccagggcaccacatttggacagcgggtggctgagaacattcccactttggggagcctttgtttcacaccctctgatccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggg

SEQ ID NO: 363905 - DNA, 723 bp, Homo sapiens
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctgggaaaaaaaaaaagtggtgggtttttttttttttttttttttttttta

SEQ ID NO: 363906 - DNA, 424 bp, Homo sapiens
cgggatactcgagctggcttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggacctgtgtcgatagagggagaatcaagattccaactcttggggtgccggagagatcagggcacggtgatgccagatcctagccagtgttgacaggtcaccttcctcacctgctttgtgtgctgtgcctacacgaggtaaccctgggctcaccacccgctgtttcctgaatgagtatctggaccgggagaa

SEQ ID NO: 363907 - DNA, 456 bp, Homo sapiens
tcccctcttgctgtctttgtgatttgataattttttatggttatatactcggattcttttccctttcttgtatctgctgaagattttttctttgtagttactgtgaagcttgcataaccctccttagaattgtaccagtctattttgagctgataacttcaatcacatacaaaaactacacttttactctcccattccccagtttgttattgatgtcagaatttgctttttatgttgtgtatccattaaccaatattttgtggttatattcttaatacttttgtcttttatgctggggttaaaagtgatttatgcaccaccattacaatattacattattctgtatttgtctatgtatttacccttagcagtgagatttatactttcatatgcttttgtgttgctatttagcaagaagctgatttttttattaatacaaattatgtacttttttca

SEQ ID NO: 363908 - DNA, 1058 bp, Homo sapiens
ggcatgatctcagctcaccgcaacctctgcctcccaggttcaagcgattctccttcctcagcctcccgagtagctgggattacaggcgtgcaccaccatgcctggccagttttgtatttttagtagagacagatttctctatgttggtcaggctggtctcaaactcccgacctcaagggatccacccaccttggcctcccaaagtgctgggattacaggtgtaagctgccgtgcccagcctatttttttttaacttcaaatactattattttaaatttatgttcattatgtaattcagggagtaacgatgcctggagcaatttctgaaatattctcaaaccacttcactcttgacactacagatttttctctcagtctcaatcagaatctctgcagtcattatttgtttttaagatgtgagggacgaggaaaattactgaagaaattctagcagatttcgattgcagagaaatttggtaacactttttgggtaactgggtaaattactatttcttttaataatcgggtgaaactctgaattgttaaaacggaccaataatcaaatggttttataatctttcttaacttcccgtccttgttataacatcttggaagaagactcttcaggataaaaaggatattatttgattaaaaattatagcatttggagaggtaacacacaaaaacaaaaacatatttgacaaagcgccctacatcctgtgttttgttaggactagaaactatactggatgagtatgtatactgcatgtttacacatgctgtgtttctttatatgtgaggcttcactgaccaccgtgcattttgaaattgtattgcattttgtgtgtgtgtgtggtgacaggtttgctcttctcacttaaggagctctggtctgtgtaggcagtacagtgttgttagggaggttgctgaattatctaaaaatgtatccatgaatttgggggaaataatgcttaatatctgaagtattttcagtaaatgtggagatatatcagataatacttttaaattagtggaaacacatttctgagtgaactgag

SEQ ID NO: 363909 - DNA, 454 bp, Homo sapiens
tgtagctgtactgcagcaagctttactaattcctttgagccctgcacaacatttttaaatggttccaaacacacaggatctctaattggtatggatttcatccacagttttcttgcaatctcaaaatgtctcggcaactcctaagcaggaattgacaggggccagcttccctatttccctttgtgaaggcagctattaataatattttttcaggttcaataaaattactgaactcaaaccatttcaaccaaaaacctggagagggagattttattttccctggcctgaacactgtctcttgctactttaaatcacagttaatgtttttaaaaatacatcttacacagaagtcagttgtagacctttagcatcaaaggacctgagctacatcacatgtaacagcctgatctttagccataatttctaagtgccattaaaaaatgtctctcaaaat

SEQ ID NO: 363910 - DNA, 800 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363911 - DNA, 860 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcacaaaaaacaacaaacaacacaaaaaaaacaacaaaaaagggggggccgcaaaaaaaccc

SEQ ID NO: 363912 - DNA, 138 bp, Homo sapiens
gcggccgcctactactactactactgctcgaattcaagcttctaacgatgtacggggacatgaagatccccgcgatacttcaacgccttctgacttccaggtgatgactgggcccccaataaatcccgtctttgggtc

SEQ ID NO: 363913 - DNA, 1198 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363914 - DNA, 1028 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363915 - DNA, 1056 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363916 - DNA, 788 bp, Homo sapiens
aaccccttgggtttttttcgtgtcggcgatgttgacgctcggatactgctatttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363917 - DNA, 965 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaaaaaaaagtcgacgcggccgcgaattta

SEQ ID NO: 363918 - DNA, 1337 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaaaaacaaaaacacacaaaataaaaacaaaaacatcacagagacagcaacaccgcacaaaaaaaaagagaataaacgcaccagaaacagtagttcacagcctcacgcaccccgcggcgcccccttcaaccacacacagacgtccgaacgctgcagtatccacgaccgcaggcgcagcgccccgaccgccttacccacaggacgcacacacgccaaagtacgacccccgccaccaatcacgcgcaagggtaacgacccgacgcaccaccacccgtctcgatagacacactcaccgcgcaaaacaatcctagcttgaacccgcccgtagctgtttatcgcgaaacccgcgtcctatgggtagtcacgcccaccacaacagcccacacatcgcggcccagcaga

SEQ ID NO: 363919 - DNA, 1132 bp, Homo sapiens
  misc_feature (1104)..(1104): n is a, c, g, or t
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaaaacataatatttatttcaaaaaatccctttataatctacatcttttaatgactaaagaaaaaaactcgagggggggccccggtacccatttcgaccctattatgagtcgtattacaaatcaactgcccgcctttttaccacctccttgacctggtaaaaccctggncgttacccaaccttaaatcccttgcaac

SEQ ID NO: 363920 - DNA, 845 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgtcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363921 - DNA, 1368 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccaggtagggacctcgatgtgcagcgagaaaggatgatcatgaagggacagttgggggtggggcagaagagtgctgctttctcctttctccagctctggaagcctgtctctgggctgccagtacaaaaactggggttatggggtactctgaatgggactgtctcttcactccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363922 - DNA, 1476 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccaggtagggacctcgatgtgcagcgagaaaggatgatcatgaagggacagttgggggtggggcagaagagtgctgctttctcctttctccagctctggaagcctgtctctgggctgccagtacaaaaactggggttatggggtactctgaatgggactgtctcttcactccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363923 - DNA, 1306 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363924 - DNA, 1148 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363925 - DNA, 885 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363926 - DNA, 1095 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgagtcctgccatgatgagccctgttcctgctcatcatgaagatccccgcgatacttcaacgccttctgacttccaggtgatgactgggcccccaataaatcccgtctttgggtcaaaaaaacaatacaaaacataatacaaaaacacctccgggacctataaagccggggggcggacaaaaacggttaaaaagggccggggtacaggggttccgacccgctttttggacaagtgggcactc

SEQ ID NO: 363927 - DNA, 1108 bp, Homo sapiens
  misc_feature (884)..(884): n is a, c, g, or t
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgtcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgtcngtgcacccttcgaaagggcccagggtaatgcaatggctgttgaaccagggaacctttcggaacttccattggttgcgcaaggtccaaaagcaagtttttgattcaatacaattctggcaataataagcctggttcttgttaataataaggatccccggaatatttcaaggctttttgatttcagagggaaggattgggccccccaataatccctgttttggggt

SEQ ID NO: 363928 - DNA, 788 bp, Homo sapiens
aatcgtgaagatggtgcgtctctactactgacacggtgctgcgcgcctggtgttctaatcatctgtcatgccggccgcgtctgtcagaatcactttcctctgtgacttgcgagtgctcggacgttctagctgcacatggagagcactctctggcacatgtttgcgtggccttgccttccgaagtgtgtcacttgactacacttgttcgtactgagagaagcactgcgcgtatcccaacgacgcactgcttccggggtcggcgggtacacgctgtgctcttgcacaacgatagcgcgcgtgtctcagatgtcatgtaacgacctgtggaataatttgtatcctagcatgaaggtatcagggtccggagatcagccctggacggccatgaactatcccggcacatacactctgcatgcagttcaaacctacaatcactctcatggataccgtcacgatctattgagttgaaagatatgggaataatctgaggaaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363929 - DNA, 935 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363930 - DNA, 974 bp, Homo sapiens
  misc_feature (956)..(956): n is a, c, g, or t
  misc_feature (971)..(971): n is a, c, g, or t
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaaaaaaaaaaaaaaaccggncttttgggggaaaanaaa

SEQ ID NO: 363931 - DNA, 1307 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcctctctgccttttgcctgttttttgtcatgtatgcaaatttgttgggagaatataagtgcttctagtccctgtattctctacatctttcagaatgactcagagctgcta

SEQ ID NO: 363932 - DNA, 1264 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgtttgtgaggagagatcgaattcgcctcctgctctcaggcctctcctgtaccagcgtaggccgccatgagtggggggcgggctcccgcggtcctgctcggcggagtggtgagtgaccggccccgccccgcccttccggtcctcgaagcctcgaccgtacccgcacctaaatcccagaggttggacccctgaggtgtgagtgtggtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363933 - DNA, 995 bp, Homo sapiens
  misc_feature (947)..(947): n is a, c, g, or t
  misc_feature (954)..(954): n is a, c, g, or t
  misc_feature (977)..(977): n is a, c, g, or t
  misc_feature (992)..(992): n is a, c, g, or t
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaacaaaaacanaccaaanaaaaaaaaaaaaaaaaaaccggncttttgggggaaaanaaa

SEQ ID NO: 363934 - DNA, 995 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcacaaaaaacaacaaacaacacaaaaaaaacaacaaaaaagggggggccgcaaaaaaaccc

SEQ ID NO: 363935 - DNA, 1088 bp, Homo sapiens
  misc_feature (1040)..(1040): n is a, c, g, or t
  misc_feature (1047)..(1047): n is a, c, g, or t
  misc_feature (1070)..(1070): n is a, c, g, or t
  misc_feature (1085)..(1085): n is a, c, g, or t
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaacaaaaacanaccaaanaaaaaaaaaaaaaaaaaaccggncttttgggggaaaanaaa

SEQ ID NO: 363936 - DNA, 946 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacaggcgggcatgatttagcccggtccgcgcaccataaaatccgcgaaaaaaagcccctgatcacggtggggccccccgtttggccaacaacacatccaacacacaacctcatacatgccacgccg

SEQ ID NO: 363937 - DNA, 1341 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcggtgagaactttgagatggatggggtgagggtgtgtactgtgtgggtgtgacttgctgggcagtctagggcttgcgtgtaagggagtgggttcttttgggtaaatctttgagtgatccccttcccccacccacctattttgtagttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363938 - DNA, 1746 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccaggtagggacctcgatgtgcagcgagaaaggatgatcatgaagggacagttgggggtggggcagaagagtgctgctttctcctttctccagctctggaagcctgtctctgggctgccagtacaaaaactggggttatggggtactctgaatgggactgtctcttcactccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtgaggtgctgatggtgagaaacatttcccccacccaacaaaatatccccaatccctgacccctttagcccttacccctcttctgagaaactgaactcaatcccactccttgattcaaccatgtttatctttgtcccttagatgattaaaacccaaagttccttggtcccagctttgacagattttgttcggtgagaactttgagatggatggggtgagggtgtgtactgtgtgggtgtgacttgctgggcagtctagggcttgcgtgtaagggagtgggttcttttgggtaaatctttgagtgatccccttcccccacccacctattttgtagttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363939 - DNA, 1576 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccagtacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtgaggtgctgatggtgagaaacatttcccccacccaacaaaatatccccaatccctgacccctttagcccttacccctcttctgagaaactgaactcaatcccactccttgattcaaccatgtttatctttgtcccttagatgattaaaacccaaagttccttggtcccagctttgacagattttgttcggtgagaactttgagatggatggggtgagggtgtgtactgtgtgggtgtgacttgctgggcagtctagggcttgcgtgtaagggagtgggttcttttgggtaaatctttgagtgatccccttcccccacccacctattttgtagttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363940 - DNA, 750 bp, Homo sapiens
cggaaacgggcgtgccatttccgcgcacgtctgcagatgcggtagtcgattggtcaagtctcccatgggctcctccttcatcaggaggtgggcaaaccgcgccatgatagggtcgggattggctggctctggaggcgcaggtggtccttcttctactgtcacatggtgcgcgctgttttctaatcacgtggctgccacccaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 363941 - DNA, 366 bp, Homo sapiens
gttttctcctgtgtgaggtggggctaggcccagcatctgctctgcaggcctgttgtgagaatcacaatggatccccatcagcccctgtcccctagtggttgttgatgaatagcaacagggattggaggattctgctgactcagtggcttccccctgccagccctgaccttggcctgagggcttcccccagttcccagctcctgctgccgctcagctctaactctccttccttcgcgtctgtttaaagtgggccttccagggtaaaaagtccattctgtgcaggctgcaggaatcaccacgtctgctggacaaggacatcaatgtctttgaagtgtcctggctggcagaattccctgccgttttgca

SEQ ID NO: 363942 - DNA, 1840 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagat

SEQ ID NO: 363943 - DNA, 2467 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaagtaagaaatgacattggaacttatgaataaatgttatatatattcagtcctgtattatgtatgtgtgtttatatgaaacgttctcttcacttttcagccttcttagagaaaaaatcagtttaaattgtttttctttctctttcctagtagaatatcatctacatccactcttcttaatagcttctctcccaatgtttttccctcaaaagtctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatc

SEQ ID NO: 363944 - DNA, 2200 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccaggcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatc

SEQ ID NO: 363945 - DNA, 2226 bp, Homo sapiens
gcgactctagaccatcgcttatggcttcctggagcggggcgcacaccttgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatc

SEQ ID NO: 363946 - DNA, 3140 bp, Homo sapiens
ctctagcagagcgccgttgctgggggaatgcagaagcggccgcgggctagcaagctcccggagccggcggcgcaccaccatgacccagtcggtggtcgtacagggtaagctacgccgggcgggtagagacctggtcgccgcggaatccagcggccatgtttcctgcttaatgtcctattctctttccttcctctcctccggtcgcagtcggccagtgcggaaaccagatcggctgctgcttctgggacctggcactaagggagcacgccgcggtcaaccaggtacccgcccgccgccgcgagccccctcgcctgtcagctaggtcttccagcccatacgcaggaaataatcgacttgagctttcatctgacccgtttaagatgcatgggatcttcccagtaaagaacgtactggtttttaaacatgttgcgtcagacacacactaaactaaaagaacactggccagcgaccttagtcttaacgtttttcctgattctcagggtctcctttttattggtgttcgtgtgcagaacagtgagatttgtatatgggaaagtactttgtaaaatagataacacgtgtggttattgtattccttaatttaaccagtcagcttttcctatgggtgaaatcctttctttagcaccccctgctgaactttttatctgtagatctggcatttactcttctaaggagattgggaagagtcaggctccgcattttgtgatacttggtttttcttatcagagtctcatcctagccattacagtattatgtaattaaaattgaaagaacttgatttgggcgagaagcaaaacctaaatgctattaacatatgtttttctttttagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaagtaagaaatgacattggaacttatgaataaatgttatatatattcagtcctgtattatgtatgtgtgtttatatgaaacgttctcttcacttttcagccttcttagagaaaaaatcagtttaaattgtttttctttctctttcctagtagaatatcatctacatccactcttcttaatagcttctctcccaatgtttttccctcaaaagtctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatc

SEQ ID NO: 363947 - DNA, 1530 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggtaaaatttttcactcatttgcctgtaacagtgttaaaggataagtgggaattcattttgcaaacgtaagtcttgtttttagacctgtgcttgataaagatagaactattcggagggtgtgtagtttgagtatataaacatacacctttttatcttaaaattttgtggaattatgtcactattttcttttcttttcttttttttttttttaatgtaagccctcttaagagtcaacagaactatactggaaaattttttttcttgtacctttagtttcttttacagaacattcagatacttttcaggatgtatgagcttttgagaaatgctgactttctccttagagtttgcctgtacagtcctatttcctagagtgaagcatttttgacgtgctcatgatgtgtgcttgccaaaggatattaataccctttctttaaccatcttcaaacctttcttgtctccaaaaagagaaaaaaaaggaaactagtttagtcaattcctttagatcatttattacatggcaattaatcaacttgaagtaaaaataaatgattggcattgctttcttcccccagggaagtctataccttagaactgaagtattttgctcccctgttctgtaaaaatagaaacagaatgtaacttgctgatttttaaatacgcttagcaaattttaaaagaacaaaatggtcacacttttttcctccaacctgagattaagattttatattcagcaagttaggtgtatgtacagttgatttttatacatattattcattgacatagcattttaagattaaaagttaaaattgctgtgtaaccatgtctttaaaagatcctcataatcatcggttaagaaacaaatttgtttctgtgctagtataattaacctgcaaatttgagctagctttttatttgatttatagttcgttatacctttttaaaaaatacctttactacccaacatctcagaagaacatacttacaattcacttaaaatagc

SEQ ID NO: 363948 - DNA, 1472 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccaggcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggtaaaatttttcactcatttgcctgtaacagtgttaaaggataagtgggaattcattttgcaaacgtaagtcttgtttttagacctgtgcttgataaagatagaactattcggagggtgtgtagtttgagtatataaacatacacctttttatcttaaaattttgtggaattatgtcactattttcttttcttttcttttttttttttttaatgtaagccctcttaagagtcaacagaactatactggaaaattttttttcttgtacctttagtttcttttacagaacattcagatacttttcaggatgtatgagcttttgagaaatgctgactttctccttagagtttgcctgtacagtcctatttcctagagtgaagcatttttgacgtgctcatgatgtgtgcttgccaaaggatattaataccctttctttaaccatcttcaaacctttcttgtctccaaaaagagaaaaaaaaggaaactagtttagtcaattcctttagatcatttattacatggcaattaatcaacttgaagtaaaaataaatgattggcattgctttcttcccccagggaagtctataccttagaactgaagtattttgctcccctgttctgtaaaaatagaaacagaatgtaacttgctgatttttaaatacgcttagcaaattttaaaagaacaaaatggtcacacttttttcctccaacctgagattaagattttatattcagcaagttaggtgtatgtacagttgatttttatacatattattcattgacatagcattttaagattaaaagttaaaattgctgtgtaaccatgtctttaaaagatcctcataatcatcggttaagaaacaaatttgtttctgtgctagtataattaacctgcaaatttgagctagctttttatttgatttatagttcgttatacctttttaaaaaatacctttactacccaacatctcagaagaacatacttacaattcacttaaaatagc

SEQ ID NO: 363949 - DNA, 754 bp, Homo sapiens
gtaagcaaggaagaaagagattaggaatagctgttgtgtctgccttacctggcctataagcagtcttattatataaatggaagttaactttatcacctgatagtgctattagccatggaagatcttatgaccatttctcatttttttatctttcagagtggttggtgatggtggaagtatttccaagggaaaaatatgttctttaaaagcacgagtaagatacatatgcttggattcttatattacatgtattttttaaataactattctcagtaactatcatgagaataaaactttaaacttttcaaagtagaaaaaaattactaagccacatttaatataaatataactaagcagacatttgtgtccacctaacacattagggggaaaagcccatactttaaaacactgtagttagcctgttttcaggagaaatagtgtctagataaatgataacaaaaggagcattcttaactctaaggacctgaaatacgtactagtacagtttaatgttttatttaaagatactggaagatttatttgcatcaaagttactaccaataaaaaacatggaaccagccacattgtagtgaataaaaaccattcaccatataagttctcctgaaccaagtacttcaggttcttagcccatatttacagtcttatttacagtcttaatcattccaacaatatttctgtgattgtctgtaacgaactactttttctgatttttgatcagtgatctttgactata

SEQ ID NO: 363950 - DNA, 2258 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatc

SEQ ID NO: 363951 - DNA, 2894 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaaaaaaaaaaaaaaacaaaacaaacacaaacacaaacaaacaaaacaaaaaacaaacaaaaaaaaaaaaaaaccagcacacaaaaaaaaaaaaatagaaaaaaaaaaaaaaacaaaacacacacaagaaaagagaaaaggaaaaaacaagaggaaaaaaagaaagagagaaagagaagaaaaaaaagagaaagagaagaaaaaaaaaaacaagaaaagaaaaaaagagaaaagaagaaaaaaagaagagaagaagaagaacaagaggaaaaaagaagaaaaaaatagaaaaaaaagaaagagagagagaaaagacaacagccaaaagaaaaaagagaaggaaaaagaaaagaaaaagtacagaaaagaaaaaaagaaagaaaagaaaaagaacaagaagaaacaaaagaaaaaaagaagaaaaaaaaaaagaaaaaagaaaaggaacagaaaaaagaaaaaaaaagaaaaaagtaaagagagaaaacaaagaaagaaaaaagacagaagaaagacaaagaaagaaagaagaagagaagaagaaaggagaagaaaaaagaagaaaagaagaagaaaggaagagaaaagaagagaaagagaagagaaagaggagagagaaagaaaaggaagaagagaaagaagagaaaaagaaagaagaagaaagagaagaagaaagaaagaagaagaaagaaggaagagaaaaggagaagacaaggaagaaagaaagaatagaaacgaagagagaagaaaagaac

SEQ ID NO: 363952 - DNA, 3194 bp, Homo sapiens
ctctagcagagcgccgttgctgggggaatgcagaagcggccgcgggctagcaagctcccggagccggcggcgcaccaccatgacccagtcggtggtcgtacagggtaagctacgccgggcgggtagagacctggtcgccgcggaatccagcggccatgtttcctgcttaatgtcctattctctttccttcctctcctccggtcgcagtcggccagtgcggaaaccagatcggctgctgcttctgggacctggcactaagggagcacgccgcggtcaaccaggtacccgcccgccgccgcgagccccctcgcctgtcagctaggtcttccagcccatacgcaggaaataatcgacttgagctttcatctgacccgtttaagatgcatgggatcttcccagtaaagaacgtactggtttttaaacatgttgcgtcagacacacactaaactaaaagaacactggccagcgaccttagtcttaacgtttttcctgattctcagggtctcctttttattggtgttcgtgtgcagaacagtgagatttgtatatgggaaagtactttgtaaaatagataacacgtgtggttattgtattccttaatttaaccagtcagcttttaaaaagattacgaagaatccagagaacgctcatttgatggacctgtcctacagtcctatgggtgaaatcctttctttagcaccccctgctgaactttttatctgtagatctggcatttactcttctaaggagattgggaagagtcaggctccgcattttgtgatacttggtttttcttatcagagtctcatcctagccattacagtattatgtaattaaaattgaaagaacttgatttgggcgagaagcaaaacctaaatgctattaacatatgtttttctttttagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaagtaagaaatgacattggaacttatgaataaatgttatatatattcagtcctgtattatgtatgtgtgtttatatgaaacgttctcttcacttttcagccttcttagagaaaaaatcagtttaaattgtttttctttctctttcctagtagaatatcatctacatccactcttcttaatagcttctctcccaatgtttttccctcaaaagtctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatc

SEQ ID NO: 363953 - DNA, 2059 bp, Homo sapiens
tgcttggtgaccatggaatcagaccaaaggaaagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatc

SEQ ID NO: 363954 - DNA, 1369 bp, Homo sapiens
ctctagcagagcgccgttgctgggggaatgcagaagcggccgcgggctagcaagctcccggagccggcggcgcaccaccatgacccagtcggtggtcgtacagggtaagctacgccgggcgggtagagacctggtcgccgcggaatccagcggccatgtttcctgcttaatgtcctattctctttccttcctctcctccggtcgcagtcggccagtgcggaaaccagatcggctgctgcttctgggacctggcactaagggagcacgccgcggtcaaccaggtacccgcccgccgccgcgagccccctcgcctgtcagctaggtcttccagcccatacgcaggaaataatcgacttgagctttcatctgacccgtttaagatgcatgggatcttcccagtaaagaacgtactggtttttaaacatgttgcgtcagacacacactaaactaaaagaacactggccagcgaccttagtcttaacgtttttcctgattctcagggtctcctttttattggtgttcgtgtgcagaacagtgagatttgtatatgggaaagtactttgtaaaatagataacacgtgtggttattgtattccttaatttaaccagtcagcttttaaaaagattacgaagaatccagagaacgctcatttgatggacctgtcctacagtcctatgggtgaaatcctttctttagcaccccctgctgaactttttatctgtagatctggcatttactcttctaaggagattgggaagagtcaggctccgcattttgtgatacttggtttttcttatcagagtctcatcctagccattacagtattatgtaattaaaattgaaagaacttgatttgggcgagaagcaaaacctaaatgctattaacatatgtttttctttttagaaaggaatttatgatgaggcaataagcagcttctttagaaatgtggacaccaggtaagatgggattaaagtctgtcacagtgtgatactttaagtttcagtagcttgggagagaattcttcaaaggacaataaaaatagccagctgcgaagttgtgtttttttgtttcattattgaaagcatatttattctattagattattaatattcttatatcattttcccgaagaagacaacagatttccctttagtgtgacttcttttaacttaaccttgaaataagtttcattaaaagaaagctgaaattttcccagagggcatcttgttaatgcatcctgtaataactaacttttgaaagaaaaatatattgtttacatatatgctgtaagtataaaaatatacttaaaaaggtgacaagcagttgttggattgtttttgtttatttaataaagagtatatgtaagt

SEQ ID NO: 363955 - DNA, 2225 bp, Homo sapiens
tccccatattatgcatggcagcacttgctactttcttttaagttgataacaatcagctcaggggtttgctctgcttgcaaggtcactgcaagaatgaacattgaactttggactatacctgaggggtgaggtaaacaacaggactataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363956 - DNA, 2122 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363957 - DNA, 2486 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataaaatttagtacaaggaacaacaaaataac

SEQ ID NO: 363958 - DNA, 2536 bp, Homo sapiens
  misc_feature (2239)..(2239): n is a, c, g, or t
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaaaaaaaaaaaaaaaaaaaaaaaaaaaaaaaaaacaaaaaaaaaaaaaanaaaaaaaaaaaaaaaaaacaaaaaaacaactaatacaaaaacataaaccaccctccttcccaaaaaaaacaaaaccacacaggcgcccaaatccgcgcctttttgcgacacaccccccttttgcgggggttattcacaattacgggccgcgttcttcaaccccgcgcgctcggaacaaccctgggtcccccccattaaaccctctttgcacaaacccccctcttcccccgtcgcgcccaaactcctggcccccccctcccaccctcttctccctctctccacccttcgtgcgtgccg

SEQ ID NO: 363959 - DNA, 2136 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363960 - DNA, 2081 bp, Homo sapiens
  misc_feature (1992)..(1992): n is a, c, g, or t
  misc_feature (2023)..(2023): n is a, c, g, or t
  misc_feature (2078)..(2078): n is a, c, g, or t
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacctatattggtaanaaggatttcatagcaaagaagggttaatagnaaaccaaccctttaacctgccttcttatgggtaactttttaacaagaggctcccnatt

SEQ ID NO: 363961 - DNA, 2416 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataaaatttagtacaaggaacaacaaaataac

SEQ ID NO: 363962 - DNA, 1959 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttttaaagatacaaaggctttattcatgtgtgatagtaaaaatcaggatgagtcttagatatacaaaaggtcgacg

SEQ ID NO: 363963 - DNA, 2400 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagaacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataaaatttagtacaaggaacaacaaaataac

SEQ ID NO: 363964 - DNA, 1725 bp, Homo sapiens
  misc_feature (1448)..(1448): n is a, c, g, or t
  misc_feature (1477)..(1477): n is a, c, g, or t
  misc_feature (1541)..(1541): n is a, c, g, or t
  misc_feature (1567)..(1567): n is a, c, g, or t
  misc_feature (1609)..(1609): n is a, c, g, or t
  misc_feature (1654)..(1654): n is a, c, g, or t
  misc_feature (1700)..(1700): n is a, c, g, or t
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccactaatntatgcatagaatattgactcaacatattnttatgatggagcactgaaggtgattgcagtttggtaatatgcttttttcttttcagtgtcattngttaatggatgaacgtactatgctanggtctgtgatatacagtagatgaggagacacagctgttcatnttctactatttaacattactgcttatgttactactataaaggatngattagacgatctaccggatatgtaaagtttactataaatctactngtatagaccacgttactccagaaac

SEQ ID NO: 363965 - DNA, 2329 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgataggtttgtacatacacacaaacacatcccaaatttaaaaataactgtttcgtatctatttatttacttcccatcacacataacaatcttctttactgttaaatacaatgccatatttcagtcttcatctcatataatctctctttaacatttagaagtaaaaatcactccttatttttgaaatactctcattttaaaaaatttctatgacactataccctgctggttttcctcatatccttcctcttctttctcctcctccacacttcctcctcttccacctcctgatttttcttcctcccacattcttccttggtttattctgtatgtgtttgtgttattcagggctatacagctttctgcctgttcacactctgcacattttacctgagcaatctcatctatcccttgattacaattaaaacacatattaggatgatcccatatatacaaagctgaaacacaatgactgaactccagacgagtctacttcctagacatattcacaaacatcttaaatttaattattcaaatctgtattgattatcttctcctaaaacatgcttatactttcacttttgtgtgatttttatatacaacctattggaggcagatgcagccaaccactagggcatataatcctataattttcagaccctgcactcccagtcatcatccactattttgcaggacatcacaaaaaccatcaggtatggcagccttgctgccatccaccccttcacaaaactgtgtgacaggaatgtattacttactccttccaccacacttcccacctcagtcagtaatcaaattctatgggttcttaatcctgagtatatttatctcatatccgtaattattatctcaagttacttcctggtgaccactcctctagatttttccactaatctcttcacttgatttcttcttgttttgtatttaatagtaagtgatttaaaataatatatttgcttttgattattgccaaatagtttataaactctttattcacatttatttttttgaaatgactttgatttttgaaatgactttttaaaaagtaaggcatgtaaaagagttcaccattccaagaggaaaatacagaaaattgattatccccataaattggcatttcggttaaataaaaagaatgaccaatttgtatatcctgtacaattctaacctaattcttttgcaaatgaataaccatatcttctaattaattttaatctaaataataattttaaggctacatacctgaatttctgaactgtaaagtgagttaatcatttaaagcatgatctgcacaaatctacttttgattctatgaacaaataaaacatttatattttgagggaatctcaattcatgcattatgccattataaacattcttagttggtgctttgttttttttgactctccggagtctggtgagccctacttggtcttacactaaatttttaaaaattcacatttcattcttttaggcctttaaacttctaatttttaggataacctaaaagtataaccctttgatagtcacataaaaccatatatactaggtaaaatgtaggcaagaagaacattttaaccccaccatttctgacaatgccacatgttctaatactttcattgtgctgaaattttcattgcattagatacatttttaaataaatgggctactggccaaggcttggaaaagtt

SEQ ID NO: 363966 - DNA, 620 bp, Homo sapiens
gatgacatttttgatattatatagtgacatatctataacatttcaaaatactagtattagactaattatagtgttgctatgacctgacctggtgtgcagtacctgggagctcatttgtagctctcatccaaagaaatttagtaaaggcgtgaaagggtcttagttatgaccattaaacctataatacctatcccagactgtatttgagtaggatcgtgatacagaaaatattatagtgacattgtatttgtcctttttcttatgtggccgtcttgtatatcatcttggtttgcctttttccttcctaactttcccatatgtagaagaagccattaagattgcttactgtgaaaagaaatgtggaaactgctctctcacggtatttttctgaattatttttctggggagaaaagaggaaatcttttaagagtttatcatgaaacacttatttagaaaactcaatgcttttgcaggtgtactaaaaataaataacaataatttttacaattaaacaaacatcctgtcatctaacctctactttatttatttatttattactattactattatttttgagacggagtctgtctctgtcgccgaggctggagtgcagtggcgcg

SEQ ID NO: 363967 - DNA, 2190 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363968 - DNA, 2124 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363969 - DNA, 2246 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagatgcgtccagttttgtttttggttgtgtcgatgaatgatgattttgttctttta

SEQ ID NO: 363970 - DNA, 2134 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363971 - DNA, 2131 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagatgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363972 - DNA, 2430 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataaaatttagtacaaggaacaacaaaataac

SEQ ID NO: 363973 - DNA, 2470 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagaacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataaaatttagtacaaggaacaacaaaataac

SEQ ID NO: 363974 - DNA, 2433 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgtttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataaaatttagtacaaggaacaacaaaataac

SEQ ID NO: 363975 - DNA, 2136 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagatgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaa

SEQ ID NO: 363976 - DNA, 2144 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattgaatttatttggacaaatccgtactgtatccaatgtcgagc

SEQ ID NO: 363977 - DNA, 1778 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagaagattgaaaagacaaagtaatattgtcttgagagataagtaaagaaaaaaatggaaagcatgtctttgtaggacttcctccattctaaactgctaattgtc

SEQ ID NO: 363978 - DNA, 1277 bp, Homo sapiens
tacgtttataaagaacaagacatagaaataaacaacaaggaggtttactgcgacgtgaccactatgctactttctgtctctgtgaatttgactactctaagtgcctcagctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacaggtccagggcagaggaccaacgtgccagcctacaggatgttgatgcggccgcgaatttagtagtagtagtcgacc

SEQ ID NO: 363979 - DNA, 339 bp, Homo sapiens
agtactatacatgagaagaaagaaagtagaagacaaaattgaaaaaataaacttatgaaatgagaagaaataagagataatgggcaaacacaataataatagatgaacctccaacggataatgaggatattaagagagaaacacaaatagtaatgagagagggaatgtaagtacagatatcaaagacattttaaaagatacttgatattacagtgtagcaaataggaattaacatttggtgaaatggggaatttctataaaaattggtaataaccaatactaactcaagaggattttagaattgttcatgggagtaactgagaaagaatttgttattta

SEQ ID NO: 363980 - DNA, 5066 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363981 - DNA, 5012 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagtacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363982 - DNA, 5039 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363983 - DNA, 5213 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggtgcgtgagcagggggcgcgcggagtctctcgtcccgctggggcctgagggagggagaagggcggaggtgggttatgtttctggggtgtcggtgcctggcctttactcggggcccctgacgattcgctcatcgccgcctccacccaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363984 - DNA, 5045 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcagacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363985 - DNA, 4930 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcgctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggtgcgtgagcagggggcgcgcggagtctctcgtcccgctggggcctgagggagggagaagggcggaggtgggttatgtttctggggtgtcggtgcctggcctttactcggggcccctgacgattcgctcatcgccgcctccacccaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363986 - DNA, 5108 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaagagtggctcaccgaggcatctgtgatctggcctccttttcagccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363987 - DNA, 4843 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgataactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363988 - DNA, 4638 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcagaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363989 - DNA, 4836 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363990 - DNA, 4226 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagtcttcgcctgatatcaggcggtgcgtctagcagggctgatgggggccagggcccacagtcttcgcctgat

SEQ ID NO: 363991 - DNA, 4063 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363992 - DNA, 3482 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagggaaacggacaatgcccattcctaagagttagatgttcgttacccgactcgacaacaacgtgtcctgctttagctcgacggtctgtgag

SEQ ID NO: 363993 - DNA, 1642 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaa

SEQ ID NO: 363994 - DNA, 1491 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggaccttgcccctcccccagagggacttgactttctttctggactgtttgtattgaaacaaagtggtgtcaaaataaagcccctgcagggcctggctccctgttggtctgagt

SEQ ID NO: 363995 - DNA, 413 bp, Homo sapiens
accgaaatccagactctttttaagaggcttcgcgcagttccaaccaacaaggtgcgtgagcagggggcgcgcggagtctctcgtcccgctggggcctgagggagggagaagggcggaggtgggttatgtttctggggtgtcggtgcctggcctttactcggggcccctgacgattcgctcatcgccgcctccacccaggcctgtttcgactgcggcgccaagaatccgagttgggccagcatcacgtacggtgttttcttgtgcattgactgttccggggtgcaccgctccctgggcgtccatctgagcttcatcaggtaggctctccgcgcggttgccgtgtttccacccggccggccaggggtgtctgggcaacaagggagagtggctgcctcgacttgggccgctctgaa

SEQ ID NO: 363996 - DNA, 314 bp, Homo sapiens
gaccgctgggcttgggagctctgtggaggctctggggtgggcctcttgttagccacaagtctgtttctcctccagagtccgtgtatctgtcagctaaaggggcccttcctgccagaggtaactgacagctgcttggggagcccagcccctgttctcagcttcctgctttagaagcggagcctggtgctcaccatatgctccctgcctcgcagtctttgttttggttcagggaatttggacgtctctggtgcttcggacgtctctggtgcttcaggtctaggttcctgtctcactctgctgggtgccagtaaata

SEQ ID NO: 363997 - DNA, 1886 bp, Homo sapiens
gaattcggcacgagctcgtgccgaatcgccgcggcgcgggcccaggagcggcaggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaa

SEQ ID NO: 363998 - DNA, 5044 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaattgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 363999 - DNA, 4944 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccagggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 364000 - DNA, 5108 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggagtccgtgtatctgtcagctaaaggggcccttcctgccagagaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 364001 - DNA, 5003 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaaccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 364002 - DNA, 5026 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 364003 - DNA, 4569 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctggggtgggattgtgtgtgtgtgcagtggctctctggtggcggggggaggcttgttggcttcaggggggattcggtctaggtctggtcgcggccggttccggtacccctttgagctgggtgttggtgggccgcccggggggggccgggaaccccgggggggggggaccgggggggggaggggcgttgaggggccgg

SEQ ID NO: 364004 - DNA, 4036 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagt

SEQ ID NO: 364005 - DNA, 3249 bp, Homo sapiens
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaacaccactgtcgggctcatgtgcatttttttgataggacacccttgccaggccaccagagggcatctagagagaggcctagcgtctgttatggggccggggttggaaaagggtttgcctgcttggtacctgctctggaacttcgagatactaatctggagtggaggggactcgctgtcaggcttgctgttaaccgagaacggctgaaggctgggcgagacgcgggccaatgcgtctgcccgttcgggccggagggacgaggagtgtttgggcagcctaatccttattcatcgatctgtaattagctggagtgggggtccccgcccccagcctcccgcagcctgcgcggcgtgggggcgactccacctgggggttgcggcgtgggaggggcggggggaagggtactacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaaggggtaggtggggagaggtggtatggtagaggggttaggagctgggtgcaggctacctgggttcactccttgaccttaccacttaccagctatatgactttggcaaaggtactgtgtttctccgaacctcgcctgtgaaagggatttaaagatttaaagggatttaaagcctgtcttcaagggctgctgggaggagtcggtgagatggagcacatctagtgcttggcggagtgcttggcacatacttggccctgtcag

SEQ ID NO: 364006 - DNA, 1641 bp, Homo sapiens
  misc_feature (1132)..(1132): n is a, c, g, or t
  misc_feature (1137)..(1137): n is a, c, g, or t
  misc_feature (1178)..(1178): n is a, c, g, or t
acatgcaaagagtttgtaacggagcattattacggtctaggtacgagctggtgggaatcggccgaggtgaggaggcacgtgtgcgggacggtctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcagggnggtgnttctgtagtttttttttttttatttttttttctggttcttnttttttttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaa

SEQ ID NO: 364007 - DNA, 723 bp, Homo sapiens
taccaaacaaacccagacttacagaactaaaagctgataatttaattctgatcagtgtcttcctcaaggccaagaagagtctatttggtgtagagagcgcagtctttctgtctcatgatactgattaccacacaaaagcattggtgaagaaacaactgactgagttgagttagggagttttttcagagtaattttgactagttgcaattttcgatttgtgctttatttagacttgcaaacccagccaaactcgtaagataagagtttccttcaaggcaacaagcacagagcatgcagaaggcacagtatcccacggacacaggcaaaggaaggcccacttgaagaaatcctgtggagaggaacagtggctcccatcagactggaagactgccttaggcctgccacaggcagcacccacagcttccacagtcagcttggctgttggtccaaagacagggtttcatggccgcacagccagagctcctgtgtcatcagccaccatacctagcaacccctgctgacgatcacgtctgatttttggcatgcatcaagtccagcatatggggaactggatttattttgcatagaggcataaacagtaagggatgtcatgataacttatcacatataatttagaagcaaaccttactatttttttattttcagagaccgaaaggaagaaatagtcttaaagaataaaaaggaaaaaattaggttggatat

SEQ ID NO: 364008 - DNA, 566 bp, Homo sapiens
  misc_feature (36)..(36): n is a, c, g, or t
cacaaagctgggaataattctttctccaatgaaccnaagtggaaagatctcataattaacagggcatatttagacttgcaaacccagccaaactcgtaagataagagtttccttcaaggcaacaagcacagagcatgcagaaggcacagtatcccacggacacaggcaaaggaaggcccacttgaagaaatcctgtggagaggaacagtggctcccatcagactggaagactgccttaggcctgccacaggcagcacccacagcttccacagtcagcttggctgttggtccaaagacagggtttcatggccgcacagccagagctcctgtgtcatcagccaccatacctagcaacccctgctgacgatcacgtctgatttttggcatgcatcaagtccagcatatggggaactggatttattttgcatagaggcataaacagtaagggatgtcatgataacttatcacatataatttagaagcaaaccttactatttttttattttcagagaccgaaaggaagaaatagtcttaaagaataaaaaggaaaaaattaggttggatat

SEQ ID NO: 364009 - DNA, 513 bp, Homo sapiens
ctcatctgaggatgtccttatattatttcttctgtccagtaggatttggtatctctgtgtaatgcacagcgagttgcttagctatcctgtccattctcagccattttccacacatatttgacgcaggactggtttgggaacaacataaaaggactagaagactagaattggtgggattctctcttgccatttaatatacagtgggactgatgaataactgataaaatatctaaatagctggccaggcatggtggctcatgcctgtaatcccagcactttgggaggctgaggtgggcgtatcacctgaggctgggagtttgacaccagcctggccaacatggtgaagccccatctctattaaaaatataaaaattagctgggcatggtggtgcgcgcctgtactcaggaagccgaggcaggagaaccgctggaatccaggaggcagaggttacagtgagctgagatcatgccgctggcactccagcctggttgacagaggaagactctgtctta

SEQ ID NO: 364010 - DNA, 3620 bp, Homo sapiens
  misc_feature (2899)..(2899): n is a, c, g, or t
tgactggctatactttccttccttattaccccagtctggtccctttggtctctatgccaaagatgacagcagctgcagcccttgctctaaattgcatgtctttgaatgatagtcatggtcaggatgcagacacaccctggctctgggatgggccccagctggcagggatcatgccctccctggaggcctgctccctaaattctccacctggccttgtagctgctcaccagccagccctcatccactgagacctcactctgtgccaggccctgggctgaatgctggggacaagggggcaaaaaccagctccttgcccacccagagcccaccatgcggtgggaggaggcagacatttgaacaaaagacattaggcggcttccaccttagggcaagagtggatggggcttagaagtgttgtgatgtagttacataagtctgggttcaagttttagctctgccacctactggctttgtgatcctgggtaagtaactgaacctctctgaggatgagtttccttatctgtaaaactaacagcagcctcatagttttgctatgaagatgaaatgagataatataggtaaacatctagctttagtggttctcaaactttcttgcccattagaatcacctgggcaacttttcaaagtccagatgtccatgctgcaccccagacacaatcaaatctgaggctccgaggatggggactgggcatgagtattttttaaagactcctccccatgggatgcagaaccatgtttggactgttggccgctgttcatggtgctggtagtggtggtgcaaattgtaaaaagtggccagcccagatcctagaagagtggctacttattgtaaatgctccgtaaaatgttcacccagccataagcagtagatcactggtttcgatactgagtactgtaggacctcaggccaggcatttatctattccaagactttaggctgtctttctcataacaaaactgatgggggcaatcattgggataatcatctcgggccgttgtaaatagtgttgcagcagggacaattttagacttctgagtatatgtttagaacattaatcagcaccttccttctctataaaaaaaaaacgactttgctctgtaatttctgtgtcattcccaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcaggtaggacttttactaatcccttcctagactggatgaatctgaaaattgttaggcttaaagtaaactgaagttacaacaaatctgtatcagtcagctatggctgtaataatgctgcataacaaaaaaaatcttaaaacttcatgacaggtctttatttcttactcatgtatctgcaggttgtctagggatcagcttctctagactgagcctgactccaggctgagagttgggttcaagtcacttccatatgactcccattcttcccaaaacatattcttctcacgggggagattgcaaactcctagtggtgagcagaaacacagaactcttaaggcctaggctcaaagatggcacattctcacacattccattggctaaagtaagtcacatggtaaagcacaacacaaataggctagggaagcatatgtctgtcaccaagtttgagggggaggaagtgaatatttgttagacagttattcaatctactacaaaatttttaatctcttgtatctgtgagtttggggtttttctttttcttctcctaaatcttgatttagatgtcctgtaatttatgttattggaggttactggaatcacagattgttgaaggtaaaaagagacttcaaatataatccaggtcaattattcttagtagggggagttatgtatcaattagagttctttggntgttagcaacagaatccaacttgactatcttaagcaaaacaggaatttattgagaggctattcaacttggagaactaaaggataagctgaataactaacctccaaaaggacagggaacagggtagcttctgggatctgggtagcaggaactaatggactgtatccttaaggcatcatctttaagaaccatgcttaggccatgggacatagtgctcaaaagtcaccttccagggagagagcatctgcttgggctggtggcttgtgtgctcaccctttggctaggaaaggcaggaacagtcattgaaagttcttctaagactgcattaaatggataaatggctgttccgcaaaggaaaattgggatatattaccagaagaaaggggaatcagaacttaagaggtgttaaacgtatcacatgctacaggaccataccacctggaggagtattagaatatggggttgggagaaagaccatggattgagaaagcgtatccaatatactcaccatatctattattttggaaagaaacccacagaacataaaattcaacacaatctttttggctgcctgagatgtgcttgtggaagaatctgtggaggcaaagtttaaaaaatctgagaacactgatggaattcagtccccttatcttaacactcatgggggaggcggacctagaggtcatgtggtggaggcagtccacaaacaatgcagctgtgatg

SEQ ID NO: 364011 - DNA, 652 bp, Homo sapiens
tatgaagatgaacagaaagcattagctggattacacagtaaggcctgggctgcgtccatcagcagaaagagatgtccccttatttggcctttctttcattcaagccttctaaaaagggttctgtaaagagaaagtgcctttgaaagtgcggtctatagtcagatgttagccagacgctcttggaataatccttcgtaatagcctcattgtgtgtttcctttttgggttttaaaagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagtgagtgggtgtccagccaggagcagtgagctcaaagctgataacgatgccttgttgcaaagtcctggacttgcgtctaacgaaaccacaggctagcccatgtgatccatgcaggagtacctagaggggttgacatcacccaggagttaagaattaaaggacacagccaagcccccgctccagcatgggtaaccttggccagcgc

SEQ ID NO: 364012 - DNA, 7021 bp, Homo sapiens
gaggttgaaaatattccaaataatttgcacctgtaccgaacatgtacagatttttccttgtcattatttccttaaaatacagtttgacaactatttatacagtatttacattgaactaggtattataagcaatctagagatgatttcaagtatatgggaggatgtgcataggttagatgcaaatatgcaaatactatgccatttaatcagcgactggagcatccatggagtttggtatctgggaggtgctggaaccaattcccttcagatactgagggatgactttacttgtaagtacaccaagcataggaatgtttggaagatgtgcctttttgcctgccccggtgagatggggagtgcttagggagtctgcccttggctctgatataaccttacccttaacactgtgttattaaacctccccccaatgctacctcttcaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtca

SEQ ID NO: 364013 - DNA, 7622 bp, Homo sapiens
tgactggctatactttccttccttattaccccagtctggtccctttggtctctatgccaaagatgacagcagctgcagcccttgctctaaattgcatgtctttgaatgatagtcatggtcaggatgcagacacaccctggctctgggatgggccccagctggcagggatcatgccctccctggaggcctgctccctaaattctccacctggccttgtagctgctcaccagccagccctcatccactgagacctcactctgtgccaggccctgggctgaatgctggggacaagggggcaaaaaccagctccttgcccacccagagcccaccatgcggtgggaggaggcagacatttgaacaaaagacattaggcggcttccaccttagggcaagagtggatggggcttagaagtgttgtgatgtagttacataagtctgggttcaagttttagctctgccacctactggctttgtgatcctgggtaagtaactgaacctctctgaggatgagtttccttatctgtaaaactaacagcagcctcatagttttgctatgaagatgaaatgagataatataggtaaacatctagctttagtggttctcaaactttcttgcccattagaatcacctgggcaacttttcaaagtccagatgtccatgctgcaccccagacacaatcaaatctgaggctccgaggatggggactgggcatgagtattttttaaagactcctccccatgggatgcagaaccatgtttggactgttggccgctgttcatggtgctggtagtggtggtgcaaattgtaaaaagtggccagcccagatcctagaagagtggctacttattgtaaatgctccgtaaaatgttcacccagccataagcagtagatcactggtttcgatactgagtactgtaggacctcaggccaggcatttatctattccaagactttaggctgtctttctcataacaaaactgatgggggcaatcattgggataatcatctcgggccgttgtaaatagtgttgcagcagggacaattttagacttctgagtatatgtttagaacattaatcagcaccttccttctctataaaaaaaaaacgactttgctctgtaatttctgtgtcattcccaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtca

SEQ ID NO: 364014 - DNA, 7417 bp, Homo sapiens
tgactggctatactttccttccttattaccccagtctggtccctttggtctctatgccaaagatgacagcagctgcagcccttgctctaaattgcatgtctttgaatgatagtcatggtcaggatgcagacacaccctggctctgggatgggccccagctggcagggatcatgccctccctggaggcctgctccctaaattctccacctggccttgtagctgctcaccagccagccctcatccactgagacctcactctgtgccaggccctgggctgaatgctggggacaagggggcaaaaaccagctccttgcccacccagagcccaccatgcggtgggaggaggcagacatttgaacaaaagacattaggcggcttccaccttagggcaagagtggatggggcttagaagtgttgtgatgtagttacataagtctgggttcaagttttagctctgccacctactggctttgtgatcctgggtaagtaactgaacctctctgaggatgagtttccttatctgtaaaactaacagcagcctcatagttttgctatgaagatgaaatgagataatataggtaaacatctagctttagtggttctcaaactttcttgcccattagaatcacctgggcaacttttcaaagtccagatgtccatgctgcaccccagacacaatcaaatctgaggctccgaggatggggactgggcatgagtattttttaaagactcctccccatgggatgcagaaccatgtttggactgttggccgctgttcatggtgctggtagtggtggtgcaaattgtaaaaagtggccagcccagatcctagaagagtggctacttattgtaaatgctccgtaaaatgttcacccagccataagcagtagatcactggtttcgatactgagtactgtaggacctcaggccaggcatttatctattccaagactttaggctgtctttctcataacaaaactgatgggggcaatcattgggataatcatctcgggccgttgtaaatagtgttgcagcagggacaattttagacttctgagtatatgtttagaacattaatcagcaccttccttctctataaaaaaaaaacgactttgctctgtaatttctgtgtcattcccaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcaggaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtca

SEQ ID NO: 364015 - DNA, 7734 bp, Homo sapiens
tgactggctatactttccttccttattaccccagtctggtccctttggtctctatgccaaagatgacagcagctgcagcccttgctctaaattgcatgtctttgaatgatagtcatggtcaggatgcagacacaccctggctctgggatgggccccagctggcagggatcatgccctccctggaggcctgctccctaaattctccacctggccttgtagctgctcaccagccagccctcatccactgagacctcactctgtgccaggccctgggctgaatgctggggacaagggggcaaaaaccagctccttgcccacccagagcccaccatgcggtgggaggaggcagacatttgaacaaaagacattaggcggcttccaccttagggcaagagtggatggggcttagaagtgttgtgatgtagttacataagtctgggttcaagttttagctctgccacctactggctttgtgatcctgggtaagtaactgaacctctctgaggatgagtttccttatctgtaaaactaacagcagcctcatagttttgctatgaagatgaaatgagataatataggtaaacatctagctttagtggttctcaaactttcttgcccattagaatcacctgggcaacttttcaaagtccagatgtccatgctgcaccccagacacaatcaaatctgaggctccgaggatggggactgggcatgagtattttttaaagactcctccccatgggatgcagaaccatgtttggactgttggccgctgttcatggtgctggtagtggtggtgcaaattgtaaaaagtggccagcccagatcctagaagagtggctacttattgtaaatgctccgtaaaatgttcacccagccataagcagtagatcactggtttcgatactgagtactgtaggacctcaggccaggcatttatctattccaagactttaggctgtctttctcataacaaaactgatgggggcaatcattgggataatcatctcgggccgttgtaaatagtgttgcagcagggacaattttagacttctgagtatatgtttagaacattaatcagcaccttccttctctataaaaaaaaaacgactttgctctgtaatttctgtgtcattcccaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtca

SEQ ID NO: 364016 - DNA, 7529 bp, Homo sapiens
tgactggctatactttccttccttattaccccagtctggtccctttggtctctatgccaaagatgacagcagctgcagcccttgctctaaattgcatgtctttgaatgatagtcatggtcaggatgcagacacaccctggctctgggatgggccccagctggcagggatcatgccctccctggaggcctgctccctaaattctccacctggccttgtagctgctcaccagccagccctcatccactgagacctcactctgtgccaggccctgggctgaatgctggggacaagggggcaaaaaccagctccttgcccacccagagcccaccatgcggtgggaggaggcagacatttgaacaaaagacattaggcggcttccaccttagggcaagagtggatggggcttagaagtgttgtgatgtagttacataagtctgggttcaagttttagctctgccacctactggctttgtgatcctgggtaagtaactgaacctctctgaggatgagtttccttatctgtaaaactaacagcagcctcatagttttgctatgaagatgaaatgagataatataggtaaacatctagctttagtggttctcaaactttcttgcccattagaatcacctgggcaacttttcaaagtccagatgtccatgctgcaccccagacacaatcaaatctgaggctccgaggatggggactgggcatgagtattttttaaagactcctccccatgggatgcagaaccatgtttggactgttggccgctgttcatggtgctggtagtggtggtgcaaattgtaaaaagtggccagcccagatcctagaagagtggctacttattgtaaatgctccgtaaaatgttcacccagccataagcagtagatcactggtttcgatactgagtactgtaggacctcaggccaggcatttatctattccaagactttaggctgtctttctcataacaaaactgatgggggcaatcattgggataatcatctcgggccgttgtaaatagtgttgcagcagggacaattttagacttctgagtatatgtttagaacattaatcagcaccttccttctctataaaaaaaaaacgactttgctctgtaatttctgtgtcattcccaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatcctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtca

SEQ ID NO: 364017 - DNA, 698 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggtaagccaatctctctctgctgctccctcttccctccactgccccagagcttagcagataggatgcaggttgccatgagctcagatggacagaataaacatcacatgctttgggttcatgttggcatttggttgtctgagataaccatcagctctgagctgttaggaatggcttgtcggaggtccaatcttagtgaa

SEQ ID NO: 364018 - DNA, 572 bp, Homo sapiens
agcggaaggaccctccctataggccagtaggtttgcaaccatgtagctccttattctgagtggcttaacctaagtggctgtgatggaagggaaaaagttaatgggtagtttctacctgttgactatgaattcttctaccagccagaggaatcactgaggtgactgagactaacaattaagggatgaaatctggaatggggagagagaagtcaaaaagtggtgttgaatatgagtcaacagggtgacgtggccatcaaaatgcgtaatgcattcctgggctatgttaatgggaatttagtgtgtctgggatcagggactgtgagtccttttctctgacagcactctcacttggagtgtagcatccactcctgaggatggcagagcaatagagtcaggccgaagcacacttaaaggagaataaccaggagggtgacaaaagccgaagctatgtcacatgcaggttggggtcttcaaccagaagacaggatcatcactttggggacaacatgggggatattgttacatgttctcagagctgctgtgcacataggggatgagactcattctacacg

SEQ ID NO: 364019 - DNA, 467 bp, Homo sapiens
cacatgaataactggatgcttggtgaaacacccctgtcttgacccctgcagatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaagtaagtgcctggacccctctctgtgtgctggggggaaggggtgtacatgtgtgtgcatgtgttcactcagctcagcccagcaccagacttctgcacttcggggctctgaggagcttgggcctcacagcccttaaccacctacggctccagcttcctgcaaagcaggtgggagggagggtgtcttctcccttctcccttctcagtttgcct

SEQ ID NO: 364020 - DNA, 626 bp, Homo sapiens
gagaccccgtctcaaaaaaatttaaaaaaaaagagctaaagcgacactttagatgggccttcaggacacagtagtagcctcctttgcccagcaaaggctgcgggaagcgctgcagttctaatgccaaggaggaattcagaccgtgagacatgctagagctctgcaatctgaatttgttgggaggctggaactaaactttcaaaactgaaacaaaagaatggatgatcatctcttcccaagtgaatgaatgtcctaattttcttttatttacttaaaaaatatttttaaagaaatgagtcaatgcccatgtgcgtaggggggtttccttgccttggagtcacaactttttgaatttgggggtctgtccagctcctaaagggtctcgtttctctgacaggacatcgaggctctgctgctgcccgggtattcaaattgttccagacagagcatggcgaatatttcaatgtttctttgtccagtgagtgggttcaaggtgaggagtttcagacaatttggtgacacctaacagtgggatagaagaccagaaatcactgtctttgcagaactaggatttatctcttataccagtaggaccactttaatttttgcagaatcaactaaaaatg

SEQ ID NO: 364021 - DNA, 4558 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccgtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtca

SEQ ID NO: 364022 - DNA, 7080 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtca

SEQ ID NO: 364023 - DNA, 2999 bp, Homo sapiens
tctccctctggtctaattggtttcttctcacacagttccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtca

SEQ ID NO: 364024 - DNA, 3453 bp, Homo sapiens
tgactggctatactttccttccttattaccccagtctggtccctttggtctctatgccaaagatgacagcagctgcagcccttgctctaaattgcatgtctttgaatgatagtcatggtcaggatgcagacacaccctggctctgggatgggccccagctggcagggatcatgccctccctggaggcctgctccctaaattctccacctggccttgtagctgctcaccagccagccctcatccactgagacctcactctgtgccaggccctgggctgaatgctggggacaagggggcaaaaaccagctccttgcccacccagagcccaccatgcggtgggaggaggcagacatttgaacaaaagacattaggcggcttccaccttagggcaagagtggatggggcttagaagtgttgtgatgtagttacataagtctgggttcaagttttagctctgccacctactggctttgtgatcctgggtaagtaactgaacctctctgaggatgagtttccttatctgtaaaactaacagcagcctcatagttttgctatgaagatgaaatgagataatataggtaaacatctagctttagtggttctcaaactttcttgcccattagaatcacctgggcaacttttcaaagtccagatgtccatgctgcaccccagacacaatcaaatctgaggctccgaggatggggactgggcatgagtattttttaaagactcctccccatgggatgcagaaccatgtttggactgttggccgctgttcatggtgctggtagtggtggtgcaaattgtaaaaagtggccagcccagatcctagaagagtggctacttattgtaaatgctccgtaaaatgttcacccagccataagcagtagatcactggtttcgatactgagtactgtaggacctcaggccaggcatttatctattccaagactttaggctgtctttctcataacaaaactgatgggggcaatcattgggataatcatctcgggccgttgtaaatagtgttgcagcagggacaattttagacttctgagtatatgtttagaacattaatcagcaccttccttctctataaaaaaaaaacgactttgctctgtaatttctgtgtcattcccaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcgaggctaggacactggcgaggctaggacactggcgaggctaggacactggcgaggctaggacactggcgaggctagga

SEQ ID NO: 364025 - DNA, 357 bp, Homo sapiens
tgctcagaatagaattgccattctcattagctttttcttcaatgcatttgttccttatttctccaactacatgcaactcggtggtagacatggttccattctataaggccgctgggtctacctgctatgaccagctcagagtaaatgtctcggtgggtgggaggagaagagggaggtttgagtgtccaagcaaatgcccagcaatgctccttgtgtgcaggctgttgttcctgaagctgaaagctcagaacgagagagagaagtttgctttctgctccatgaaaggctgtgagaggataaagattaaagctctgattccaaagaacgcaggcgtcagtgactgcacagccacagctt

SEQ ID NO: 364026 - DNA, 401 bp, Homo sapiens
tagagatgggtgtcctggttatttcctttgttctccacctggtagctgcctgcactcacagcatgttgggaatggtgattataaatgtaaccatgctctcttcttgtaagtggagagcccaggtacctcttatccagcatgtgaccctctttctacctcaggatagtcatactcttaggctacctggatttattcagggccaaaggagtggtcaaggtcctttttgttttgccctattccctttggaaaacatttagtttatgcccatgttacagattgcaaaatacaggcacatattctcactaatgtggtctgcatgtccctttgcaaggatcacgaggtcaggagatggagaccatcctggctaacacagtgaaacacagtctctactaaaaaataca

SEQ ID NO: 364027 - DNA, 747 bp, Homo sapiens
tatcgtcgacccacgccgctcggagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatata

SEQ ID NO: 364028 - DNA, 758 bp, Homo sapiens
aacttaggcttaggtacgaggcctgggtggttgaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatata

SEQ ID NO: 364029 - DNA, 994 bp, Homo sapiens
cagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaaaaaaaaaaaaaagggggggggtaaagaatctgaggggtcaagtatcggtccaggtcttggaaggggcccaggggggaataaacaggcgcggcgctaaaagcggggcaagcgcgggttgggaacacatggg

SEQ ID NO: 364030 - DNA, 3203 bp, Homo sapiens
aacttaggcttaggtacgaggcctgggtggttgaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggtgaggagcgcggccctcttgtccactctgcgggtctggtctgagggggcggagccggctgcaagtggaaagggaccgggaccaacctggtaaaccattccccaagtctgagtcccccagaaccttgggctgaacccgcccctccatcgcctctaatggaagactggttagggctgcggagttaggggtggcgtagattggagatgcttggctagtggaaagaatggattgccttccggcattagagaaattagattggcaccttgttttcttgctcggttggatccgtgatgttatgtcctcacagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagaggatgttgggctccaggataagctccttcctcttggtgaggggaaggggtaagaaagagggtctatgcgagagaaggattaggaaattaaacctcctaggaatttcctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactctgcttctgctaaaaaatatacccctcttctgtcttagcatgaatatccaccctagctaggtatctaggagtcatacctaacttctagagaaaccactttccttaaaaccacatctttattttaaatagatggattgtggctgggctcctgtagcttttcctcttagaccccagaaatatatctccctttgggacttccaacagttccctacatgctttttgagcatctgctagttcccagcatcaatttaggcagaagggatacaatatccactgttcatctaatagagactagagataagaaacaacctgtaccatcaatgagctcacaataacaggccactgccactaccacagtggcctcaagggacactgcttcccctttaatgttttggtccaaataaaagtacatgaatcctaaaacatttgctaaaggctcagggataacacaaggaaagtaacagcatcaagaattttactgccgggtgcggtggctcacgcctgtaatccccacactttgggaggccaaggcaggcagatcataaggtcaggagatcaagaccatcctggctaacacggtgaaaccccgtctccactaaaaatacaaaaagttagctgggcgtggttgcgggcacctatagtcccagctactcaggaggctgaggcaggagaatggcgtgaacctgggaggcggagcttgcagtgagctgagattgtgccactgcactccagcctgggcaacagagcgagactctgtctcaaaaaaaaagaattttactaatctggcttataaataacttcttcaactagtggactgctccccccaagtccatctaggcacctctttaatgcgttccaaacccaagagcaccactctcaaaggttcccaccgtcttgggcgccgttctttacagtaaggtagacaaagtaatgatcactcctttctcaaaaggtaacaagtttaggctttacagttaatacactgtaag

SEQ ID NO: 364031 - DNA, 1943 bp, Homo sapiens
cagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactctgcttctgctaaaaaatatacccctcttctgtcttagcatgaatatccaccctagctaggtatctaggagtcatacctaacttctagagaaaccactttccttaaaaccacatctttattttaaatagatggattgtggctgggctcctgtagcttttcctcttagaccccagaaatatatctccctttgggacttccaacagttccctacatgctttttgagcatctgctagttcccagcatcaatttaggcagaagggatacaatatccactgttcatctaatagagactagagataagaaacaacctgtaccatcaatgagctcacaataacaggccactgccactaccacagtggcctcaagggacactgcttcccctttaatgttttggtccaaataaaagtacatgaatcctaaaacatttgctaaaggctcagggataacacaaggaaagtaacagcatcaagaattttactgccgggtgcggtggctcacgcctgtaatccccacactttgggaggccaaggcaggcagatcataaggtcaggagatcaagaccatcctggctaacacggtgaaaccccgtctccactaaaaatacaaaaagttagctgggcgtggttgcgggcacctatagtcccagctactcaggaggctgaggcaggagaatggcgtgaacctgggaggcggagcttgcagtgagctgagattgtgccactgcactccagcctgggcaacagagcgagactctgtctcaaaaaaaaagaattttactaatctggcttataaataacttcttcaactagtggactgctccccccaagtccatctaggcacctctttaatgcgttccaaacccaagagcaccactctcaaaggttcccaccgtcttgggcgccgttctttacagtaaggtagacaaagtaatgatcactcctttctcaaaaggtaacaagtttaggctttacagttaatacactgtaag

SEQ ID NO: 364032 - DNA, 752 bp, Homo sapiens
cagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatata

SEQ ID NO: 364033 - DNA, 2890 bp, Homo sapiens
cagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagaggatgttgggctccaggataagctccttcctcttggtgaggggaaggggtaagaaagagggtctatgcgagagaaggattaggaaattaaacctcctaggaatttcctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactctgcttctgctaaaaaatatacccctcttctgtcttagcatgaatatccaccctagctaggtatctaggagtcatacctaacttctagagaaaccactttccttaaaaccacatctttattttaaatagatggattgtggctgggctcctgtagcttttcctcttagaccccagaaatatatctccctttgggacttccaacagttccctacatgctttttgagcatctgctagttcccagcatcaatttaggcagaagggatacaatatccactgttcatctaatagagactagagataagaaacaacctgtaccatcaatgagctcacaataacaggccactgccactaccacagtggcctcaagggacactgcttcccctttaatgttttggtccaaataaaagtacatgaatcctaaaacatttgctaaaggctcagggataacacaaggaaagtaacagcatcaagaattttactgccgggtgcggtggctcacgcctgtaatccccacactttgggaggccaaggcaggcagatcataaggtcaggagatcaagaccatcctggctaacacggtgaaaccccgtctccactaaaaatacaaaaagttagctgggcgtggttgcgggcacctatagtcccagctactcaggaggctgaggcaggagaatggcgtgaacctgggaggcggagcttgcagtgagctgagattgtgccactgcactccagcctgggcaacagagcgagactctgtctcaaaaaaaaagaattttactaatctggcttataaataacttcttcaactagtggactgctccccccaagtccatctaggcacctctttaatgcgttccaaacccaagagcaccactctcaaaggttcccaccgtcttgggcgccgttctttacagtaaggtagacaaagtaatgatcactcctttctcaaaaggtaacaagtttaggctttacagttaatacactgtaag

SEQ ID NO: 364034 - DNA, 1913 bp, Homo sapiens
cagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagaggatgttgggctccaggataagctccttcctcttggtgaggggaaggggtaagaaagagggtctatgcgagagaaggattaggaaattaaacctcctaggaatttcctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactctgcttctgcta

SEQ ID NO: 364035 - DNA, 1065 bp, Homo sapiens
aacttaggcttaggtacgaggcctgggtggttgaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggtgaggagcgcggccctcttgtccactctgcgggtctggtctgagggggcggagccggctgcaagtggaaagggaccgggaccaacctggtaaaccattccccaagtctgagtcccccagaaccttgggctgaacccgcccctccatcgcctctaatggaagactggttagggctgcggagttaggggtggcgtagattggagatgcttggctagtggaaagaatggattgccttccggcattagagaaattagattggcaccttgttttcttgctcggttggatccgtgatgttatgtcctcacagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatata

SEQ ID NO: 364036 - DNA, 2827 bp, Homo sapiens
aacttaggcttaggtacgaggcctgggtggttgaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagaggatgttgggctccaggataagctccttcctcttggtgaggggaaggggtaagaaagagggtctatgcgagagaaggattaggaaattaaacctcctaggaatttcctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactctgcttctgctaaaaaatatacccctcttctgtcttagcatgaatatccaccctagctaggtatctaggagtcatacctaacttctagagaaaccactttccttaaaaccacatctttattttaaatagatggattgtggctgggctcctgtagcttttcctcttagaccccagaaatatatctccctttgggacttccaacagttccctacatgctttttgagcatctgctagttcccagcatcaatttaggcagaagggatacaatatccactgttcatctaatagagactagagataagaaacaacctgtaccatcaatgagctcacaataacaggccactgccactaccacagtggcctcaagggacactgcttcccctttaatgttttggtccaaataaaagtacatgaatcctaaaacatttgctaaaggctcagggataacacaaggaaagtaacagcatcaagaattttactgccgggtgcggtggctcacgcctgtaatccccacactttgggaggccaaggcaggcagatcataaggtcaggagatcaagaccatcctggctaacacggtgaaaccccgtctccactaaaaatacaaaaagttagctgggcgtggttgcgggcacctatagtcccagctactcaggaggctgaggcaggagaatggcgtgaacctgggaggcggagcttgcagtgagctgagattgtgccactgcactccagcctgggcaacagagcgagactctgtctcaaaaaaaaagaattttactaatctggcttataaataacttcttcaactagtggactgctccccccaagtccatctaggcacctctttaatgcgttccaaacccaagagcaccactctcaaaggttcccaccgtcttgggcgccgttctttacagtaaggtagacaaagtaatgatcactcctttctcaaaaggtaacaagtttaggctttacagttaatacactgtaag

SEQ ID NO: 364037 - DNA, 899 bp, Homo sapiens
gttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggtgaggagcgcggccctcttgtccactctgcgggtctggtctgagggggcggagccggctgcaagtggaaagggaccgggaccaacctggtaaaccattccccaagtctgagtcccccagaaccttgggctgaacccgcccctccatcgcctctaatggaagactggttagggctgcggagttaggggtggcgtagattggagatgcttggctagtggaaagaatggattgccttccggcattagagaaattagattggcaccttgttttcttgctcggttggatccgtgatgttatgtcctcacagctcatcgactatgggaagctgggagacactaacgaacgagccatgcgcatggctgacttctggctcacagtgagtgcgacctatctgccttcaaaatcccaccctttgctccctgggggtgggggttggaaaaaggagaactatgcagaattaaacttgggtactcacttatgggccagtgctgctaactaaattagaaactgtgtcttaagttagttgaagtcgatgtgaatatacctctgcacaactgcctataaacgacccctttgtgtaacactgactatgccagattggcgaggggagggggaggtctttctatgtgtggatggaccttacctttgggaatggtgtaaagttaaatgcctctgcagttttgcctgactctgctgtctcttggataattctccct

SEQ ID NO: 364038 - DNA, 2456 bp, Homo sapiens
  misc_feature (2450)..(2450): n is a, c, g, or t
  misc_feature (2452)..(2452): n is a, c, g, or t
  misc_feature (2456)..(2456): n is a, c, g, or t
tgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccagggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaangnattn

SEQ ID NO: 364039 - DNA, 2448 bp, Homo sapiens
  misc_feature (2442)..(2442): n is a, c, g, or t
  misc_feature (2444)..(2444): n is a, c, g, or t
  misc_feature (2448)..(2448): n is a, c, g, or t
aaaggaacaataatgaggacatgcaaccaaaaacttacatagggagaacaactttacttactcagggaaggcaaagagaccacttaagaactccttcacatgtgttatgtcttaaaagctgactactggagttgtatcccttgcacagcatccccttgcaccaaagtgaacactactctaagaacatgtgttcagctctcctgaatgccaagcacaaccatgcttggcatggcagtggtgtcttatttctgctcctctttttccccagggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcgggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaangnattn

SEQ ID NO: 364040 - DNA, 2430 bp, Homo sapiens
  misc_feature (2424)..(2424): n is a, c, g, or t
  misc_feature (2426)..(2426): n is a, c, g, or t
  misc_feature (2430)..(2430): n is a, c, g, or t
tgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggatgaagaaaatgaatcacaagtcaactgacagtccaaaggctccacagctcagaggagggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaangnattn

SEQ ID NO: 364041 - DNA, 204 bp, Homo sapiens
  misc_feature (198)..(198): n is a, c, g, or t
  misc_feature (200)..(200): n is a, c, g, or t
  misc_feature (204)..(204): n is a, c, g, or t
tcttcctgtatattagtttgattaatatctgagaagtgtattagtctaccacacctctcctacatcagtcgccccccctccccaagtacattttcccatcatatatatatatgtatatctatatctctaaactgctgttaattgattaaaatctggcaaagttatatttactttaaaataaaataattttattgcaangnattn

SEQ ID NO: 364042 - DNA, 2402 bp, Homo sapiens
  misc_feature (2396)..(2396): n is a, c, g, or t
  misc_feature (2398)..(2398): n is a, c, g, or t
  misc_feature (2402)..(2402): n is a, c, g, or t
tgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccagggtgtatttgatatagtgtttgcaacaaattcgacccaggtgatcaaaatgattctcaactcttctactgaagatggtattatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaangnattn

SEQ ID NO: 364043 - DNA, 651 bp, Homo sapiens
ctttagtttcttccacttctagcaccacgtgtagtttcccaatttctcttacccaaatttgctcgcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttgatgcttcataaatgttaaatg

SEQ ID NO: 364044 - DNA, 2372 bp, Homo sapiens
  misc_feature (2366)..(2366): n is a, c, g, or t
  misc_feature (2368)..(2368): n is a, c, g, or t
  misc_feature (2372)..(2372): n is a, c, g, or t
tgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaangnattn

SEQ ID NO: 364045 - DNA, 2514 bp, Homo sapiens
  misc_feature (2508)..(2508): n is a, c, g, or t
  misc_feature (2510)..(2510): n is a, c, g, or t
  misc_feature (2514)..(2514): n is a, c, g, or t
tgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccagatgaagaaaatgaatcacaagtcaactgacagtccaaaggctccacagctcagaggagggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaangnattn

SEQ ID NO: 364046 - DNA, 2318 bp, Homo sapiens
  misc_feature (2312)..(2312): n is a, c, g, or t
  misc_feature (2314)..(2314): n is a, c, g, or t
  misc_feature (2318)..(2318): n is a, c, g, or t
tgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcaangnattn

SEQ ID NO: 364047 - DNA, 2956 bp, Homo sapiens
ggcaactttagctaccgccgctgtcgctcccgctgccgccgccgcccagacgcactctgggaaagcgcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364048 - DNA, 454 bp, Homo sapiens
  misc_feature (78)..(78): n is a, c, g, or t
gccaggaaagggcccatgtggcagaaggcaaagtacaggcactggtctcaaaagtcacctgcctacaaatgtacaaanggcgaaggttctgatggcttccccactatgggatgacgaggcgagagggaagcccttgctgcctgccattcccagaccccagccctttgtgctcaccctggttccactggtctcaaaagtcaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364049 - DNA, 2781 bp, Homo sapiens
ggcaactttagctaccgccgctgtcgctcccgctgccgccgccgcccagacgcactctgggaaagcgcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagacggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364050 - DNA, 2693 bp, Homo sapiens
ggcaactttagctaccgccgctgtcgctcccgctgccgccgccgcccagacgcactctgggaaagcgcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364051 - DNA, 1977 bp, Homo sapiens
ggcaactttagctaccgccgctgtcgctcccgctgccgccgccgcccagacgcactctgggaaagcgcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364052 - DNA, 2844 bp, Homo sapiens
ccaggcggccacaggtcctgcagctgattccaagaagacttgcaacacacgctgcagcctgtcagtgggtcagccagtctgtcatttctcaggcgactcatccccaccattggtcaagtcagtctcctctgatgcgttgaagctgagattctatcagggcagacagtccgtaaccacgtacagccatcgagtcagacagctatgccgattttgctcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364053 - DNA, 2762 bp, Homo sapiens
ggcaactttagctaccgccgctgtcgctcccgctgccgccgccgcccagacgcactctgggaaagcgcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacagcccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364054 - DNA, 1965 bp, Homo sapiens
gacagaggacaggctgctaagccaggaagcagaatcaaagtaaacagcagtccccatgtgtctcctgtgtgctgtgcactgttcttggctgagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaaaaaaaaaaaaataacgtgc

SEQ ID NO: 364055 - DNA, 352 bp, Homo sapiens
gttcctgcaaccagccccatccgcttggttctgggcccctaaactgcctcctcttctcatgcactatgcactgggttgaacgcagcaacaatacagacttccctcccagcacggtggctcatgcctgtgattctagcgctttgtgatattagtccgcccaggcggacggactgcttgagctcaggagttcgagaacagcctaggcaacaaaacgagaccctacaaaaactacaaaaaattagtcgggtgtggtgtcgcgcacctgtggtcccagctgctccacaggctgaggcgggaggatagctggagcccaagaaggcgaggctgcactgagcagtgatcacgccactgc

SEQ ID NO: 364056 - DNA, 1253 bp, Homo sapiens
  misc_feature (1231)..(1231): n is a, c, g, or t
agcagaaccgtttggcagggaaaaccatacactgaaagcggacctcgccgctatctcgggcctgatggcgcggacgcaaacgtggccccacccccttcttcccggcgtccgtgcgcaggggacgggccgtcgctacgcagactggcccaccgacagccctcccagcccgcccccgactcagccacctcctctcggagaaagcagctgggggcggagacggagatcagccctgcgctttgcggcattgtatgacgtcaagtaggcgaggcttcggaggcgagcgaagggcgggaccaaggccaagagcccgacagttacgccactcacacttgcggaagagttaacgggacagtggtgcaggccaatcgcaaccagtcctctggaggcagggagactggggtggagacttcggagactgcagttgcagttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcattctcagttcttctatcaagctgcgtgcttttataaaagtttatctgtcgaaacacaaaaaaaaaaaaaaatgtgggccgccgccctgaagtttacaatttgggcgcgggccggagaacggccgggccaaacgggcgaggggggtcccaaaaccggcgggtggaccaggtggtctgtacaggcctcacccccgcggggggngcgaagaggaaacgctctacag

SEQ ID NO: 364057 - DNA, 533 bp, Homo sapiens
  misc_feature (15)..(15): n is a, c, g, or t
ccccttcgtgccggnagactgcagtgcagttgttccgtgtaggggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcaggtactttaccttgtctatgcctcagattttatgatttggataattaagttctattttatactgcactcaagtttttccccacaagaacatgcaacagtaatttttaattcta

SEQ ID NO: 364058 - DNA, 1174 bp, Homo sapiens
agcagaaccgtttggcagggaaaaccatacactgaaagcggacctcgccgctatctcgggcctgatggcgcggacgcaaacgtggccccacccccttcttcccggcgtccgtgcgcaggggacgggccgtcgctacgcagactggcccaccgacagccctcccagcccgcccccgactcagccacctcctctcggagaaagcagctgggggcggagacggagatcagccctgcgctttgcggcattgtatgacgtcaagtaggcgaggcttcggaggcgagcgaagggcgggaccaaggccaagagcccgacagttacgccactcacacttgcggaagagttaacgggacagtggtgcaggccaatcgcaaccagtcctctggaggcagggagactggggtggagacttcggagactgcagttgcagttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcaggtcttcccaggtcagcatttcccaaagttctctggaacattaatcccttgaactacgctgggacagaagaaatttttttgatggtgtcagctttgtttgggggatccctgtgttgtattattttagaaaaagaagacgacaggttgaacaaaaatggaagcaaaatttgaagaaaataactctgcgagaaaagaaaatttccgtcctgtgttgtattcatgtattacggggagaggagggtctaaccgatttaaaaatttatcctctccttagcaaattcatcctctccttatattagggaaaagtacttcttagctataaggcatttcttgaaagctctcagcttgttctaattctaagcaaccttctgaatataatttggtttcccatgtagatcaccctaaagagaatgtcctattcataacactgcagtaatcactatgatgacagcagatttccatttctgcgaagttaagggtcagacacatgaccttgcaattac

SEQ ID NO: 364059 - DNA, 2220 bp, Homo sapiens
agcagaaccgtttggcagggaaaaccatacactgaaagcggacctcgccgctatctcgggcctgatggcgcggacgcaaacgtggccccacccccttcttcccggcgtccgtgcgcaggggacgggccgtcgctacgcagactggcccaccgacagccctcccagcccgcccccgactcagccacctcctctcggagaaagcagctgggggcggagacggagatcagccctgcgctttgcggcattgtatgacgtcaagtaggcgaggcttcggaggcgagcgaagggcgggaccaaggccaagagcccgacagttacgccactcacacttgcggaagagttaacgggacagtggtgcaggccaatcgcaaccagtcctctggaggcagggagactggggtggagacttcggagactgcagttgcagttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccaga

SEQ ID NO: 364060 - DNA, 1552 bp, Homo sapiens
ttgtaatataggcattttgtaatatgtttgttggcagataaataatatattatataattattctagatattaattaggaggcaattaaaatatgcttttataaatatatttaagtcaagagtaaggaaacctctttaaggtaatattgaaaataattatggaataaaatattcttgctgtttttctgtgttctttatttttgcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccaga

SEQ ID NO: 364061 - DNA, 1975 bp, Homo sapiens
agcagaaccgtttggcagggaaaaccatacactgaaagcggacctcgccgctatctcgggcctgatggcgcggacgcaaacgtggccccacccccttcttcccggcgtccgtgcgcaggggacgggccgtcgctacgcagactggcccaccgacagccctcccagcccgcccccgactcagccacctcctctcggagaaagcagctgggggcggagacggagatcagccctgcgctttgcggcattgtatgacgtcaagtaggcgaggcttcggaggcgagcgaagggcgggaccaaggccaagagcccgacagttacgccactcacacttgcggaagagttaacgggacagtggtgcaggccaatcgcaaccagtcctctggaggcagggagactggggtggagacttcggagactgcagttgcagttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccaga

SEQ ID NO: 364062 - DNA, 2068 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctctggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgca

SEQ ID NO: 364063 - DNA, 1109 bp, Homo sapiens
  misc_feature (3)..(3): n is a, c, g, or t
acntgataagtatatctaaactatatcatactatatgtgtgtgattcatcttgtgtttgtggttgctggtatctttgtactacagctgtatttcagtagagggactggtcggtagaccgttttctccagctaagcagggaatgttgtgcgtgtattgcaggcgagagttcagtaccagtgtatgccggttagtaagtatgagagccgtgttccttgctggtgacatgtgccagtgcttaatacgctggtaactgtgagttctcctatagcatcctgatctcaagttgtcgaccatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttca

SEQ ID NO: 364064 - DNA, 348 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacggtgcgtggggaccgaggcagccctgacagtcccgcgtgcccgcccgggccctccgtcc

SEQ ID NO: 364065 - DNA, 6125 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcatatttggtttataagcatttatatgtggggtttatttgttcttttgttttttccatcttaaatattatcatggctaaaacttaagggtatttatagtttaattccatttcagttttatagagggcagtaattattctgatgaatgttgaattaagaaatggatattttctttctctgttgtgcagttattggtagatcaatttcttataacccacaatgtagcatcaataattgatagcatgtattttatttaattacttgaattatttagacttgatttctctaattttttccataaaaggactgaacagcacctacttgtggtctggacagcttaacccagagttcctggaagaataaatgctgttagcatctggttaatttactggcagacagaagcctacttacagtggctttcaactttttgaccacatctttactgtggaatctcatcaaagacttggaagcaagggtggtgagaggggcctggggcgtggtgtggagggtcgagttctttgtcgtcccacagtcacccccaggaccaccttgcgaagccgaaaatacacatctgcattttaccgacaaggaacgccgctcagaaagctgcagacatttgcctggggtcacgcttacagtgggcagatgaactggatgtaaatacaggctgccctggaccattcctcagaactcatgggattttcgcgaccctcatcctcagtgaagttagatgaccattcctgcctttcatcccaccgattttcctaagtatctgttgcctgcaactaacactagttcctgtgtcagtaaagtactgcacttggttgcaaagaatagagatggactctgccaacataggcacggaaggtttacggggtggatggcatggctcacagatgtgatgagaaagccccggaagaagtgttgggcacagccttaggcacaacctttcctgggctcttcccatcactgaatgatccatgtatctccgggactctccttctagatccaaagtttagggcggcggaatcggactgctctggcctttgacacgtgcctgtgctttgcctgtcaacgctatggggagagagatgtcagcttacagaaaattgaggttctgtgattcagtttccctctgctctcttagaataaaagtgcttactcattgtttaaagcattctccaaattagtctgcaaattctttgatagtatacatccttaaaaaaaaa

SEQ ID NO: 364066 - DNA, 5855 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcatatttggtttataagcatttatatgtggggtttatttgttcttttgttttttccatcttaaatattatcatggctaaaacttaagggtatttatagtttaattccatttcagttttatagagggcagtaattattctgatgaatgttgaattaagaaatggatattttctttctctgttgtgcagttattggtagatcaatttcttataacccacaatgtagcatcaataattgatagcatgtattttatttaattacttgaattatttagacttgatttctctaattttttccataaaaggactgaacagcacctacttgtggtctggacagcttaacccagagttcctggaagaataaatgctgttagcatctggttaatttactggcagacagaagcctacttacagtggctttcaactttttgaccacagtaagaaataacccattacacacacacacacacacacactctctctctctctctctctctctctctctctgtctctcagatacgtataagcaaaaatttaacaagacagtacttgtttttcctaagtgtgcatgctggcatcttctgttttattatttttaaaaatactagacacagacactaagttactttgtggcctcctaatagatggcagacttcagtttgaaaagcatccctttggaatgtggtttaaaagaagaaataatacaaagacctttttggagttttttttttttttggtttttgaatattgtttaggtaaaaattattgctgcaaacacaactgaagcaaaagtactgtgtacgcaaattacttgttgcactgtagaaaatgtaatatcaggagaagttcctaaaactcacaaatatatacaaaatttcaaaacttggtgattgatccatatgtcttgaaggaatattaggcaataaacttaccttttcaagagagttatttaacttccaa

SEQ ID NO: 364067 - DNA, 4873 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364068 - DNA, 4786 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacggttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364069 - DNA, 5095 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcaggatctccttctgtcccctaggccggagagcagtggggcaatcatggctgactgtagcctcgacctcctgggctcaagtgattctccaacctcagcctcctgagtatcctgcactacagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaaggagggcaagatgtccaggcaaaaccttgtttaaatgttcatcaccatagaaacatgacagcttctccatagagcttttggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364070 - DNA, 4759 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364071 - DNA, 3933 bp, Homo sapiens
cagatgacgatcatcatgactaagtatagcgtcggtcaggtcaagctagctaccagcaagtacttgataatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364072 - DNA, 4131 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctctggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364073 - DNA, 3211 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagacgtttggttttgtgggagctgcgcttgaaaccattttgattttctatcttatggtgtcctctgttgttggtttctatagccttcgattttttggaaactttactcccaagaaagatgacacaactatgacaaagatcattggaaattgtgtgtccatcttggttttgagctctgctctgcctgtgatgtcgagaacactggggcttcataaacttcacttaccaaatacttcaagggattcagaaacagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364074 - DNA, 2658 bp, Homo sapiens
  misc_feature (3)..(3): n is a, c, g, or t
acntgataagtatatctaaactatatcatactatatgtgtgtgattcatcttgtgtttgtggttgctggtatctttgtactacagctgtatttcagtagagggactggtcggtagaccgttttctccagctaagcagggaatgttgtgcgtgtattgcaggcgagagttcagtaccagtgtatgccggttagtaagtatgagagccgtgttccttgctggtgacatgtgccagtgcttaatacgctggtaactgtgagttctcctatagcatcctgatctcaagttgtcgaccatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364075 - DNA, 800 bp, Homo sapiens
tctctggatccatgaccatccttttccttttatagatgtactgttccatctggaagtcaagattggtgccacctaagtgggttcctgctgcaaggaacttaaggacatcctcctccttcatttgcaggacatcaagggctccggacattgtgaaaatttccctttaagttacgacgggaatccagaacaacgccgtatggacccctcttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364076 - DNA, 1220 bp, Homo sapiens
aggactagagtgatgtagaagaatctgttgtgtctgagtgtgaggaggtggagagtcacgtgtgggctatgggtctgagaactgaagttttaacagttactaaaactgttttgtggctgttgtaatgtcttctcctttcctttcctttgaaaagctgttactgaatgaacgatgccgcttacaaacactgacacttcagaaccaagcatatttgatactgctgtagctatttatattgattctgcaacttctctttaacagcatcttgaagtcatccacagttgttctatatggactccacagtagagtcagagaactaagtgacaagtggagcatcgtcctcctcctgctcacttcctcctcgccacctctctggcctggctatccttcagtctgaagagtgattcactttttcttttctttttagtctttactgtggaatctcatcaaagacttggaagcaagggtggtgagaggggcctggggcgtggtgtggagggtcgagttctttgtcgtcccacagtcacccccaggaccaccttgcgaagccgaaaatacacatctgcattttaccgacaaggaacgccgctcagaaagctgcagacatttgcctggggtcacgcttacagtgggcagatgaactggatgtaaatacaggctgccctggaccattcctcagaactcatgggattttcgcgaccctcatcctcagtgaagttagatgaccattcctgcctttcatcccaccgattttcctaagtatctgttgcctgcaactaacactagttcctgtgtcagtaaagtactgcacttggttgcaaagaatagagatggactctgccaacataggcacggaaggtttacggggtggatggcatggctcacagatgtgatgagaaagccccggaagaagtgttgggcacagccttaggcacaacctttcctgggctcttcccatcactgaatgatccatgtatctccgggactctccttctagatccaaagtttagggcggcggaatcggactgctctggcctttgacacgtgcctgtgctttgcctgtcaacgctatggggagagagatgtcagcttacagaaaattgaggttctgtgattcagtttccctctgctctcttagaataaaagtgcttactcattgtttaaagcattctccaaattagtctgcaaattctttgatagtatacatccttaaaaaaaaa

SEQ ID NO: 364077 - DNA, 375 bp, Homo sapiens
tagtagagacagggtttcatcatgttggccaggctggtctcaaactcctgacctcagatgatccacccgccttggcctcccaaggtgctggggttacaggtgtgagccaccatgcccagcctatgttttattaaaactttaatgagtaaaatgtccagcattttaactttttagtagtttaaatccttttttcctataaatatcacagatatatcttctagtatttaaaaaagatatgcaaaaaagtaaatgatctgttaacttcgttttgtttcagatatgtttccttctttttgccattctctacgttgtttcctacttcatcatcacaagatacaagagaaaatcaggcaagtggaaacatgtcaattaaaa

SEQ ID NO: 364078 - DNA, 4899 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364079 - DNA, 884 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatgtagagactggtttcaccgtgttagccaggatggtctcgatctcctgaccttgtgatccgcccgcctcagcctcccaaagtgctgggattacaggcgtgagccaccgtgcccggctgcatgtgtgtattatatatagcatatgcagtttatacctttaaaacctttaatattatattgtgttttccataccttttatgttcttcaaaaccatttttagtggtgtaacctgagccatgtatttagcaatatattaagctagtggttttcaaaggctatttcgtcattttaaagggtggaaccatttatccctccagtgacttgctacctgcatttttttcaga

SEQ ID NO: 364080 - DNA, 6139 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcatatttggtttataagcatttatatgtggggtttatttgttcttttgttttttccatcttaaatattatcatggctaaaacttaagggtatttatagtttaattccatttcagttttatagagggcagtaattattctgatgaatgttgaattaagaaatggatattttctttctctgttgtgcagttattggtagatcaatttcttataacccacaatgtagcatcaataattgatagcatgtattttatttaattacttgaattatttagacttgatttctctaattttttccataaaaggactgaacagcacctacttgtggtctggacagcttaacccagagttcctggaagaataaatgctgttagcatctggttaatttactggcagacagaagcctacttacagtggctttcaactttttgaccacatctttactgtggaatctcatcaaagacttggaagcaagggtggtgagaggggcctggggcgtggtgtggagggtcgagttctttgtcgtcccacagtcacccccaggaccaccttgcgaagccgaaaatacacatctgcattttaccgacaaggaacgccgctcagaaagctgcagacatttgcctggggtcacgcttacagtgggcagatgaactggatgtaaatacaggagcggcagagaggacaggcatggaaaggaggcctgtctcccacggagaactcctctagtgccagcagacacgcatggtggaacacatgtgagcaggacaggagggccatctctctggaacgcctgcctgcacccacgcgctgaccgccagcagcggagagaggggccaggcagatggagcactcgtgggtctcccggcgcagagcctgcggcacacaggacaggaagaggccacgcggctccctgcaggaagcgtgccctgcagcaggcgcgaaccacccgagcggcctccacatgcacctagacaggcacgccggctgggtgctcacacctgggcccttgcacctgtgtctgcccagaggggctggtcagcacaccctttacaatgaaggctcacaaagtacacaactccaagtgccagtccatgaaagcagttcgcatagacttttcatgcagttgagtctaatttatattttactatccacttaccctatgtaaccaaatatcatttttacacttattaacaattcatacttttttcttccttaagaggaattaaagcatttcctcaatgaga

SEQ ID NO: 364081 - DNA, 5947 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcatatttggtttataagcatttatatgtggggtttatttgttcttttgttttttccatcttaaatattatcatggctaaaacttaagggtatttatagtttaattccatttcagttttatagagggcagtaattattctgatgaatgttgaattaagaaatggatattttctttctctgttgtgcagttattggtagatcaatttcttataacccacaatgtagcatcaataattgatagcatgtattttatttaattacttgaattatttagacttgatttctctaattttttccataaaaggactgaacagcacctacttgtggtctggacagcttaacccagagttcctggaagaataaatgctgttagcatctggttaatttactggcagacagaagcctacttacagtggctttcaactttttgaccacatctttactgtggaatctcatcaaagacttggaagcaagggtggtgagaggggcctggggcgtggtgtggagggtcgagttctttgtcgtcccacagtcacccccaggaccaccttgcgaagccgaaaatacacatctgcattttaccgacaaggaacgccgctcagaaagctgcagacatttgcctggggtcacgcttacagtgggcagatgaactggatgtaaatacaggagcggcagagaggacaggcatggaaaggaggcctgtctcccacggagaactcctctagtgccagcagacacgcatggtggaacacatgtgagcaggacaggagggccatctctctggaacgcctgcctgcacccacgcgctgaccgccagcagcggagagaggggccaggcagatggagcactcgtgggtctcccggcgcagagcctgcggcacacaggacaggaagaggccacgcgggttagtttcatcacagcagaaagttacttaaactgaaatgcgaaccatgtgccccgagacatgggtcttcgaaacatgcggaagtttcattctgtgttaaaatcacatgcattttatttatatatatacatatatatatacacaca

SEQ ID NO: 364082 - DNA, 3350 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttca

SEQ ID NO: 364083 - DNA, 5017 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcaggatctccttctgtcccctaggccggagagcagtggggcaatcatggctgactgtagcctcgacctcctgggctcaagtgattctccaacctcagcctcctgagtatcctgcactacagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364084 - DNA, 4817 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttca

SEQ ID NO: 364085 - DNA, 4871 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggactgaacagcacctacttgtggtctggacagcttaacccagagttcctggaagaataaatgctgttagcatctggttaatttactggcagacagaagcctacttacagtggctttcaactttttgaccacatctttactgtggaatctcatcaaagacttggaagcaagggtggtgagaggggcctggggcgtggtgtggagggtcgagttctttgtcgtcccacagtcacccccaggaccaccttgcgaagccgaaaatacacatctgcattttaccgacaaggaacgccgctcagaaagctgcagacatttgcctggggtcacgcttacagtgggcagatgaactggatgtaaatacaggctgccctggaccattcctcagaactcatgggattttcgcgaccctcatcctcagtgaagttagatgaccattcctgcctttcatcccaccgattttcctaagtatctgttgcctgcaactaacactagttcctgtgtcagtaaagtactgcacttggttgcaaagaatagagatggactctgccaacataggcacggaaggtttacggggtggatggcatggctcacagatgtgatgagaaagccccggaagaagtgttgggcacagccttaggcacaacctttcctgggctcttcccatcactgaatgatccatgtatctccgggactctccttctagatccaaagtttagggcggcggaatcggactgctctggcctttgacacgtgcctgtgctttgcctgtcaacgctatggggagagagatgtcagcttacagaaaattgaggttctgtgattcagtttccctctgctctcttagaataaaagtgcttactcattgtttaaagcattctccaaattagtctgcaaattctttgatagtatacatccttaaaaaaaaa

SEQ ID NO: 364086 - DNA, 2836 bp, Homo sapiens
cccgcccccgactgcgcggcgcccgccctagcggagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgca

SEQ ID NO: 364087 - DNA, 607 bp, Homo sapiens
aagggtcacctgtgcccagcggctcacactctgccagcctgcccctcccacatgctaagccgtgctgccctctgcctggacagaggttccagggaacggcacggttcctccatttgggttcagggtgcatctcctcagacatttccaccttatttcaaacatctcacccctcacttcactctctctccccttcctctctttgcatttttcttcctggcacttattcttgaaaattgtaacaaaatattttattatttgtctctccccagctccctgcaggaagcgtgccctgcagcaggcgcgaaccacccgagcggcctccacatgcacctagacaggcacgccggctgggtgctcacacctgggcccttgcacctgtgtctgcccagaggggctggtcagcacaccctttacaatgaaggctcacaaagtacacaactccaagtgccagtccatgaaagcagttcgcatagacttttcatgcagttgagtctaatttatattttactatccacttaccctatgtaaccaaatatcatttttacacttattaacaattcatacttttttcttccttaagaggaattaaagcatttcctcaatgaga

SEQ ID NO: 364088 - DNA, 475 bp, Homo sapiens
atgtttagaacaaaagatcatacaaattactggagatggaatatgctgaaacccacagaggtaatgggtaagaaaggaaaggtgggcacagcttagtacttagctgtctaagacatggcaggtgagggaaagaaaggcagacaggaatagctcctgatttccagcttggatggccatgtggtaataataaccagaatagagtaaaaagaggaggagtgctaaggtgctaaggagcaaggagtgagcccatacatttatgtttaatttgagcttttcacggtctgtccaggtgaaaacattcaataaggcaaactcacttgccagagctctttggaacagatctatttgagcaatatggatttgagaatggtaacaagaaatttaaaatactgttcagaggagcagaattctacttctgggtagatggagtagacttactttttcctcttcctcccactaagtagaactaaaaacc

SEQ ID NO: 364089 - DNA, 2332 bp, Homo sapiens
  misc_feature (2329)..(2329): n is a, c, g, or t
  misc_feature (2332)..(2332): n is a, c, g, or t
ggggggcgggtgtgggtggggtgcggggtggacggtggtgccgcgtgggggggccgtcagtcgtgagccggtgctggcatccttcttctcttctctccctccgcctgcggtctcgcgctcgtcgcacgctgtatttcttcctctcccgcccgctcgctttctcggtgttggcgtccggcggtcccggcgctcattctcagctgccactctgctaggcgtcgtcgccgctcgtgcttgagtctccccgcgcccccacctcctcgccccgcctctctgctgcgtgcgcgcgcgcgcggctgttgctcggtcccgccgtccgcccgtggtcgctccgcgcgggtgccggcgcgcgcgtagtgcggggggtgggggcgcagggggggcggggagtcgggggtgggcgtggtggcgcggcgtggtgtgtcggtgtggcgtgtgtggcctcctggtgggtgttttgttgctgtagagtgctgcttctgtgttgggcgttgtgtgcgctgtgtggagtgtgcgagggtgcctgtttggctgccctctctgtgttgtgttgtgttgtctgcagtgtgcagttgggttgtcggcgttggggggtggtcgcgcgtggtcggtttgtcgctcgctgtcaggcgggtgtcgttgccctatgtgtctggcgtgtgccgcttggtggtcgtgtgcttgtgtgtttttttttcctctgttgtacgctttctctttttgtctgcttgttttgggtcctttttctcttctgtagtctgtggtggtgtgttctcttttccctctttgggtggtgtttgttgtggcgcgcccccgcgcgcgggtgtgtttttggtgtgtcgcgctcttgtgtgcgcgttgttttcctgtctctgttttttgttttgtttttcttttgttgttttttttttttttgttgttttgttttttttttttttttttttttttaactaataacttcaatttttaataatggaaacaattttgccattctagaaactattttaggggagaaaaatcttccctacaaaaataaacttaaacccatcaaaattataaatattataactttttacttctgccatttaaaatgctctcctgcaataccaccccttcatttaacatccttcctgtaccatcacatattgaagagaaaacagtattacagcaaagcttagatagtttaacataatgatttgtacaatgattcttaaaaaatctttggccttagtggccttttttcttcacttacacattaaaaatgctgctgcagtaaccagtgtttgggaaaggacatcagtcttcaagaaccataaactgacagaatttcaatacagtaggtttccaaattgcaatttgtagtgcacatgacagtaagcgaggttttgggtaaatatagatgaggatgcctattcagacaatctacttcaagtaaaaaaaaaaaaaaaaaaaaaattcacagatacccatcagctactactttaggttctaacagtgtcttaatctgagaaacaaatgcttcacaaaatataagtttactgggatgaataattaaaaaaccaggtggtaataacaatatactcaaatccaggccatagtctgaataataaaaccagtacaaaaaatcacgaaggcattccctgaacaataaaggtaaagtgttggatgacaatgtcactaaaacctcatcaatgtacaaaagagaagttacatgcaaaattaaacaagatgtgccatacatattttatagctaattctatttttttcaactttccttaaatgcttaggaagatatgattgtctcagtaaattgtgtggcacagcataacaacttaagtctgcctccaacaagatgggtattctccaaaaagtcagaagagccaccaagagacgaacagaaatgcaataaaaggcacagttcacttgggcaaagaactgaagcaccttggaatttcaaaaagaatccattaggtgtcaccaaagtgttaacaattccttgggaatttataaacaaaaaatatctagactaaaaatagaatataaggcccctctggaaccactgcacacctttccctctgttctcagattaaactgctgcataaaatgaggttatttagcctgtttttaaggaaggcttctattgcacatgcatctctttggttggtaataacatgtacttttgttaaaatatttccataatgaagccctgttgtgtggttagctgggtgtggactttcctccctttcttgggggccctcctactcacagtcaagttgccctttagaactaaagatctggtaggattgggtctttattcaatagccctgtnccn

SEQ ID NO: 364090 - DNA, 1670 bp, Homo sapiens
ggggggcgggtgtgggtggggtgcggggtggacggtggtgccgcgtgggggggccgtcagtcgtgagccggtgctggcatccttcttctcttctctccctccgcctgcggtctcgcgctcgtcgcacgctgtatttcttcctctcccgcccgctcgctttctcggtgttggcgtccggcggtcccggcgctcattctcagctgccactctgctaggcgtcgtcgccgctcgtgcttgagtctccccgcgcccccacctcctcgccccgcctctctgctgcgtgcgcgcgcgcgcggctgttgctcggtcccgccgtccgcccgtggtcgctccgcgcgggtgccggcgcgcgcgtagtgcggggggtgggggcgcagggggggcggggagtcgggggtgggcgtggtggcgcggcgtggtgtgtcggtgtggcgtgtgtggcctcctggtgggtgttttgttgctgtagagtgctgcttctgtgttgggcgttgtgtgcgctgtgtggagtgtgcgagggtgcctgtttggctgccctctctgtgttgtgttgtgttgtctgcagtgtgcagttgggttgtcggcgttggggggtggtcgcgcgtggtcggtttgtcgctcgctgtcaggcgggtgtcgttgccctatgtgtctggcgtgtgccgcttggtggtcgtgtgcttgtgtgtttttttttcctctgttgtacgctttctctttttgtctgcttgttttgggtcctttttctcttctgtagtctgtggtggtgtgttctcttttccctctttgggtggtgtttgttgtggcgcgcccccgcgcgcgggtgtgtttttggtgtgtcgcgctcttgtgtgcgcgttgttttcctgtctctgttttttgttttgtttttcttttgttgttttttttttttttgttgttttgttttttttttttttttttttttttaactaataacttcaatttttaataatggaaacaattttgccattctagaaactattttaggggagaaaaatcttccctacaaaaataaacttaaacccatcaaaattataaatattataactttttacttctgccatttaaaatgctctcctgcaataccaccccttcatttaacatccttcctgtaccatcacatattgaagagaaaacagtattacagcaaagcttagatagtttaacataatgatttgtacaatgattcttaaaaaatctttggccttagtggccttttttcttcacttacacattaaaaatgctgctgcagtaaccagtgtttgggaaaggacatcagtcttcaagaaccataaactgacagaatttcaatacagtaggtttccaaattgcaatttgtagtgcacatgacagtaagcgaggttttgggtaaatatagatgaggatgcctattcagacaatctacttcaagtaaaaaaaaaaaaaaaaaaaaaattcacagatacccatcagctactactttaggttctaacagtgtcttaatctgagaaacaaatgcttcacaaaatataagtttactgggatgaataattaaaaaaccaggtggtaataacaatatactcaaatccaggccatagtctgaataataaaaccagtacaaaaaatcacgaaggcctgatggtagcagactgcggggatcctctaggtca

SEQ ID NO: 364091 - DNA, 372 bp, Homo sapiens
aaatcacaaatgtccttttcagttaatatgcatatatgcatgtgtgtgtgtgtgtgtgtgtgtgtgtgtgtgtgtgtgtatcattcttcttcatgaagaaaaatgttggggaatgctcttctagttgtgttactgaactgaacttgggtctgcccatcaggttcaccaaagccaaacagttacatcaagatttgcagtgagagaaagtgagacacttttttcagggtgccaagcaaggagaattgggcagctcatgctaaagacccaacctcctctatggcttatatataagggtttttaaaggtagggaaacagaggttacgttacatgcaaagacatacatcaacacatgaagtatatacattgatttgg

SEQ ID NO: 364092 - DNA, 869 bp, Homo sapiens
cacgttgaaaaggcaggggaggaagtgagcagggccgggcgtggtctgcaggctagatctagtgctttatctactgggcggctgagctagagactgccggtgccttcatgggcaggactaggccgaaaactccccagattgtcattcttcagggatggcagccctaaacacagcatggcaactcatctactcactcatgaaagattaaaaaatggaaaccaacgtatttcatcttatgctctgcgtcacttctgctcggactcataaatccacgtctctttgctttggccacttcaactcatatccaagccttcctttaattcatgatttattgctggaagatgatgtcaggtcataggatgatatatataatcagtgagcaggcagaatgaggagacagttgaaagttctctacaacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacagagaagaaagctgaggcaagatttaagattgtggaagaaagagcctggcttacgaatttttaaaaactatgtgtgt

SEQ ID NO: 364093 - DNA, 308 bp, Homo sapiens
cacgttgaaaaggcaggggaggaagtgagcagggccgggcgtggtctgcaggctagatctagtgctttatctactgggcggctgagctagagactgccggtgccttcatgggcaggactaggccgaaaactccccaggtaggacagagtcccatatctctcacgtctcttggtgggagggagttccgaggcaacctcctggagggtgggagttccgtagcaggcatgcatgctttggtttgtaaatcgactattagctcttgaggagagtcttggagcacagagttagaggaacttgccctctataaa

SEQ ID NO: 364094 - DNA, 890 bp, Homo sapiens
  misc_feature (790)..(791): n is a, c, g, or t
  misc_feature (797)..(797): n is a, c, g, or t
cacgttgaaaaggcaggggaggaagtgagcagggccgggcgtggtctgcaggctagatctagtgctttatctactgggcggctgagctagagactgccggtgccttcatgggcaggactaggccgaaaactccccagattgtcattcttcagggatggcagccctaaacacagcatggcaactcatctactcactcatgaaagattaaaaaatggaaaccaacgtatttcatcttatgctctgcgtcacttctgctcggactcataaatccacgtctctttgctttggccacttcaactcatatccaagccttcctttaattcatgatttattgctggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacgtgagactcctgattgcttctggaaatactgtgtctgaagtgaaataagcatctgttagtcagctcagaaacacccatcttagaatatgaaaaataacacaatgcttgatttgaaaacagtgtggagaaaaactaggcaaactacaccctgttcattgttacctggaaaataaatcctctatgttttgacaaaaaanntaatanatatatattatataatttaattttatatttatatatattttttaatttatatatattttaatttattaataatttaatttaagggtttatttc

SEQ ID NO: 364095 - DNA, 1089 bp, Homo sapiens
  misc_feature (989)..(990): n is a, c, g, or t
  misc_feature (996)..(996): n is a, c, g, or t
cacgttgaaaaggcaggggaggaagtgagcagggccgggcgtggtctgcaggctagatctagtgctttatctactgggcggctgagctagagactgccggtgccttcatgggcaggactaggccgaaaactccccagattgtcattcttcagggatggcagccctaaacacagcatggcaactcatctactcactcatgaaagattaaaaaatggaaaccaacgtatttcatcttatgctctgcgtcacttctgctcggactcataaatccacgtctctttgctttggccacttcaactcatatccaagccttcctttaattcatgatttattgctggaagatgatgtcaggtcataggatgatatatataatcagtgagcaggcagaatgaggagacagttgaaagttctctacaacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacgtgagactcctgattgcttctggaaatactgtgtctgaagtgaaataagcatctgttagtcagctcagaaacacccatcttagaatatgaaaaataacacaatgcttgatttgaaaacagtgtggagaaaaactaggcaaactacaccctgttcattgttacctggaaaataaatcctctatgttttgacaaaaaanntaatanatatatattatataatttaattttatatttatatatattttttaatttatatatattttaatttattaataatttaatttaagggtttatttc

SEQ ID NO: 364096 - DNA, 456 bp, Homo sapiens
gtccgtctcccaggaggccaccagtggccccaaagatgcccatcgaaatctccccaaggaggctcttcaaaatcctcttaccaaaaagtaagcacttcttcaccttttgggtttgctgtagtaaaaattgcccagggatgacaaagggaagggctttatacagtctagaaggatttctcttactaagagcagctgtgcatgttgaatattacatttccctgtttgctaaaggctggggctgtgctagccaatacaagcctgctggccgcatgtggctactggctgctgggaatgcagctggtccaaagggagaggtgctggaagtaaaatgcacactggctcttgaagacttggtacaggcaaaagaaggtaaaaacagcgaattaatactttttatggtgttttaaatatacgtttttttaaatacttgtaacattaaatataaattataatttt

SEQ ID NO: 364097 - DNA, 6756 bp, Homo sapiens
cggcggcggacgcggcgggctcggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgagatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagttcgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaaacaaaaaaacttaggttttcttggagtctgtgctagttgaatcttgcaaatgcaaaccacatacgctctttaatgaaaacctttgcatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatg

SEQ ID NO: 364098 - DNA, 6861 bp, Homo sapiens
cggcggcggacgcggcgggctcggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgagatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagttcgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaaacaaaaaaacttaggttttcttggagtctgtgctagttgaatcttgcaaatgcaaaccacatacgctctttaatgaaaacctttgcatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatg

SEQ ID NO: 364099 - DNA, 6823 bp, Homo sapiens
agcggacttgttactacggaacttggtgtccatgagtccgatctgtacacgcgaataaggccgattagactacacatctgtccgaactgtctgacacctctagtcaaccatgaaagcatggcctccaacacagaggtgcagtatccacctggtccatggagggaacgcatgcatggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgagatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagttcgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaaacaaaaaaacttaggttttcttggagtctgtgctagttgaatcttgcaaatgcaaaccacatacgctctttaatgaaaacctttgcatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatg

SEQ ID NO: 364100 - DNA, 6814 bp, Homo sapiens
agctttaactgtaagtagcgagcttggtttccatgagtcacatgtgtccacagaataggcccaactagacaacagatctgtgggaatgtttggctctccatgaaccacaaagactcctccaacacagaggtgcagtacccacctgggccaaggagggaagatgcaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgagatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagttcgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaaacaaaaaaacttaggttttcttggagtctgtgctagttgaatcttgcaaatgcaaaccacatacgctctttaatgaaaacctttgcatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatg

SEQ ID NO: 364101 - DNA, 6625 bp, Homo sapiens
agcggacttgttactacggaacttggtgtccatgagtccgatctgtacacgcgaataaggccgattagactacacatctgtccgaactgtctgacacctctagtcaaccatgaaagcatggcctccaacacagaggtgcagtatccacctggtccatggagggaacgcatgcatggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgagatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagttcgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaaacaaaaaaacttaggttttcttggagtctgtgctagttgaatcttgcaaatgcaaaccacatacgctctttaatgaaaacctttgcatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatg

SEQ ID NO: 364102 - DNA, 2076 bp, Homo sapiens
agcggacttgttactacggaacttggtgtccatgagtccgatctgtacacgcgaataaggccgattagactacacatctgtccgaactgtctgacacctctagtcaaccatgaaagcatggcctccaacacagaggtgcagtatccacctggtccatggagggaacgcatgcatggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactgtttggactttgagcactgtttggactctgggcactgtttggactctgagcactgtttggactctgggcactgtttggactctgagcactgtttggactctg

SEQ ID NO: 364103 - DNA, 2089 bp, Homo sapiens
agcggacttgttactacggaacttggtgtccatgagtccgatctgtacacgcgaataaggccgattagactacacatctgtccgaactgtctgacacctctagtcaaccatgaaagcatggcctccaacacagaggtgcagtatccacctggtccatggagggaacgcatgcatggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtaacccacacacagagagcccttttgtccaaaaggaacacgaccagcagctcttgtactctcctgcactgaaaggcagtacgtatgctagggctgtgggaaacactggatggtaaagtgcactctgtaggggcaaggactgtattttgctcgtaaccatatactcagttgctatgtaataataaagcactcatttatgtgctcaaacttatttgaataaaggaattaaagaattgttgactggtgataacattgccttgagtacagtgttgatagtatcagagtggaccccaaagatgagaggtgatgaagatccatcggtctcctcagcagggctcttcctcccttgccttttgt

SEQ ID NO: 364104 - DNA, 1798 bp, Homo sapiens
cggcggcggacgcggcgggctcggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtaggatttactgccctttccatggtactgattatgcgggactacaaagttgttgggactcctggttgcaatctactgaagcctcttcaaactaacttaaatatggaatgtaaccaggcagtagaggtataggcatgcatgggggcccaggatgacgggagtcaaaggcatcaagtccagctcttcgtgttcatgcctgggccgcctcatcttctccctgtggctggatctttgtcacggccagctgcctaggtcatagtttcccagctactcagccaaggaagaagttccagtttaagacatcgcaggacagggccatgattgcagagtttaggccaaatgcccatccctgaagaagtgggacagggactttaagaagagaagtggcattccccagagaaaggcaggagggaggggacgattctgggcagatagtcgcctgccggagatagttaagtacagtctagttttctttcctcttttactgactaatggtattttgaccatcatttaattttttttaaaatggtggctgatactttagttgaggttgacattatctaagtaacaataaagaaatgtcataataatttataagctatttataattctagccccctgaaacaactgtttttgtttcatccacaaaa

SEQ ID NO: 364105 - DNA, 6704 bp, Homo sapiens
cggcggcggacgcggcgggctcggccacaggtaacccgcaggagccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgagatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagttcgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaaacaaaaaaacttaggttttcttggagtctgtgctagttgaatcttgcaaatgcaaaccacatacgctctttaatgaaaacctttgcatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatg

SEQ ID NO: 364106 - DNA, 6472 bp, Homo sapiens
agcggacttgttactacggaacttggtgtccatgagtccgatctgtacacgcgaataaggccgattagactacacatctgtccgaactgtctgacacctctagtcaaccatgaaagcatggcctccaacacagaggtgcagtatccacctggtccatggagggaacgcatgcatggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcagatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgagatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagttcgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaaacaaaaaaacttaggttttcttggagtctgtgctagttgaatcttgcaaatgcaaaccacatacgctctttaatgaaaacctttgcatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatg

SEQ ID NO: 364107 - DNA, 2803 bp, Homo sapiens
agcggacttgttactacggaacttggtgtccatgagtccgatctgtacacgcgaataaggccgattagactacacatctgtccgaactgtctgacacctctagtcaaccatgaaagcatggcctccaacacagaggtgcagtatccacctggtccatggagggaacgcatgcatggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgt

SEQ ID NO: 364108 - DNA, 1656 bp, Homo sapiens
  misc_feature (1618)..(1618): n is a, c, g, or t
  misc_feature (1624)..(1624): n is a, c, g, or t
agcggacttgttactacggaacttggtgtccatgagtccgatctgtacacgcgaataaggccgattagactacacatctgtccgaactgtctgacacctctagtcaaccatgaaagcatggcctccaacacagaggtgcagtatccacctggtccatggagggaacgcatgcatggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcgttttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagattcttggtgatnatctgngatgtaagatcagattgacctttgttaggctg

SEQ ID NO: 364109 - DNA, 1556 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctta

SEQ ID NO: 364110 - DNA, 2803 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttcttaaaaaaaaaaaacacacaaaaaaacacaaaaaaaaaaaaaaaaaaaaaaaaaaaaaaaaaaaaaaaaaaaaaaaaaaaaaaaaaaaaaaaaaaaaaaaaaaaagagaagcaagagaaaagaaaagagaagaggggtatagaaaaagaaaaaaaaaagaaaagagaagcaaaaaagagggaggaatcaagaaacgaagaaaggaagaacaagaggaagaatagagagagagagagagaaacaaggaagaaaaaaaaaaacacacagagaagaaaagaggaagcagagagagaagcaagacagccgaagagacagaaggcaagaagacggaacaaaaacgacggagagagaaagcacagacagacaaagaagagagggagcaggagagcaagaggaaggacaaaagaagcgacacgaaacgaacagaaaaagagaggaggacacagcagagaagaaagggaagagaggaccggaagaacaaaagggagacggacaagacgagagaagacgggaaacaacgagaggaagaagcaagacaaacgaagagataaacaacgccaaacgaagcacgcaagaacccgaaacacgaaagaaacacgagacgagacagagaagcaagcggaaagagacagagaaacagaaacacgagaaaacgaaagcaagaaaaccacgagaaagacgacaccgagcaaaaagaagaagagcaggaaaaagaactaagaaaagcatacagaagcagcgcgaggaacgaaagcaagagagacgaaagggaaacgagaggaacagagcagacaacacagccgcgaagaggacccgcaacgcaagaaagagaaaaagagacggcaggagcgagaagagagaaggacaagcgcgcacaacagagacacgagagaaagaggaagcaggagcaaacgccaagaacaaagagaggagagaggaacgcgccaaaccgagcaggaagagagcgagagagagggcagaacgaggaggagacggacacggaagaagcgacagggaaggaaggagagagaagaggaagcacaaagcaaggacacaaaaaaaagaagcaacacgaagacaaacacaaagagacaaagacaaaaacacaggaacacgaacaaaaaaggagaaggggaggagacaagcgaaggaatagcaaagagaaaagagagagaaacgagcaaagaagagaaaaagagagaaagcagcgacaagagagcaggacacgcaggcagaaaaagaagagagac

SEQ ID NO: 364111 - DNA, 1364 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgctta

SEQ ID NO: 364112 - DNA, 2616 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcactccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttcttaaaaaaaaaaaacacacaaaaaaacacaaaaaaaaaaaaaaaaaaaaaaaaaaaaaaaaaaaaaaaaaaaaaaaaaaaaaaaaaaaaaaaaaaaaaaaaaaaagagaagcaagagaaaagaaaagagaagaggggtatagaaaaagaaaaaaaaaagaaaagagaagcaaaaaagagggaggaatcaagaaacgaagaaaggaagaacaagaggaagaatagagagagagagagagaaacaaggaagaaaaaaaaaaacacacagagaagaaaagaggaagcagagagagaagcaagacagccgaagagacagaaggcaagaagacggaacaaaaacgacggagagagaaagcacagacagacaaagaagagagggagcaggagagcaagaggaaggacaaaagaagcgacacgaaacgaacagaaaaagagaggaggacacagcagagaagaaagggaagagaggaccggaagaacaaaagggagacggacaagacgagagaagacgggaaacaacgagaggaagaagcaagacaaacgaagagataaacaacgccaaacgaagcacgcaagaacccgaaacacgaaagaaacacgagacgagacagagaagcaagcggaaagagacagagaaacagaaacacgagaaaacgaaagcaagaaaaccacgagaaagacgacaccgagcaaaaagaagaagagcaggaaaaagaactaagaaaagcatacagaagcagcgcgaggaacgaaagcaagagagacgaaagggaaacgagaggaacagagcagacaacacagccgcgaagaggacccgcaacgcaagaaagagaaaaagagacggcaggagcgagaagagagaaggacaagcgcgcacaacagagacacgagagaaagaggaagcaggagcaaacgccaagaacaaagagaggagagaggaacgcgccaaaccgagcaggaagagagcgagagagagggcagaacgaggaggagacggacacggaagaagcgacagggaaggaaggagagagaagaggaagcacaaagcaaggacacaaaaaaaagaagcaacacgaagacaaacacaaagagacaaagacaaaaacacaggaacacgaacaaaaaaggagaaggggaggagacaagcgaaggaatagcaaagagaaaagagagagaaacgagcaaagaagagaaaaagagagaaagcagcgacaagagagcaggacacgcaggcagaaaaagaagagagac

SEQ ID NO: 364113 - DNA, 1062 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcaagggactgcttcagttgtcgacgcggccgcgaatttagtagtagtaggcggccgc

SEQ ID NO: 364114 - DNA, 998 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagcgagtcagctaaatacttcgccgcgcgtgggaatagctattattattggaaccgtgtag

SEQ ID NO: 364115 - DNA, 1465 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctta

SEQ ID NO: 364116 - DNA, 1263 bp, Homo sapiens
gtacacatccggacactcttagaacagcaaatagggcccaaagccatttccaatcatccccactcattttcttctccggccttgcagatcgctgtggagaatggcttcgggggtgtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctta

SEQ ID NO: 364117 - DNA, 560 bp, Homo sapiens
aggccttggtaggatggaagagattggaaatgaggtattaatatttagtggttctttaaaaaattatgttaaaacctggaatgcagaacactttagcagataaaaggcaggatggaagagattggaaatgaggtatttttagtggttcttaaaaaattgttaaaacctggaatgcagaacactttagcagataaaaggctcactgtgcctttacccacccagttgcagatccaccaagtagatattgaagagcagtgggcaggggtgatgaagttggctggtctttgacccaagggccctgtccttttctacttagctgacttggagctagatgaggtggaagacttccttggagagctgttgaccaacgagtttgatacagttgtggaagacgggagtctgccccaggtgagcttatcacgggcacaactgcagtctccctacctgtagtctttcttctccccagctgtctgttttgggccaagactcttgactatgactctgttgcctagaggaaaaagtgtagcctttccaaaccctgccttttctttatttctata

SEQ ID NO: 364118 - DNA, 1542 bp, Homo sapiens
ccgggacgtcacgtggactggggccggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctta

SEQ ID NO: 364119 - DNA, 1450 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctta

SEQ ID NO: 364120 - DNA, 1280 bp, Homo sapiens
  misc_feature (36)..(36): n is a, c, g, or t
  misc_feature (38)..(38): n is a, c, g, or t
gggggggggaaaaaaactataggctagtagaggctngntggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcactctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgctta

SEQ ID NO: 364121 - DNA, 1569 bp, Homo sapiens
aacagtatattacacaaggtcgagctcctgttttcaatttcagttaccgggcgggtatgtcgtgtacttcacagggatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctta

SEQ ID NO: 364122 - DNA, 1516 bp, Homo sapiens
ccgggacgtcacgtggactggggccggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttatttttgaggattgcagacctgtggactggttaccccatctccaccctctcccctgttcgaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctta

SEQ ID NO: 364123 - DNA, 4211 bp, Homo sapiens
ctacccttgagaggggcaagaggggtggtcaagccgccgccgccgcgacggcccccgcggtgcgggttgcgccagcctcctcggagctcgacgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccagtggtgaaatagggccttctaaacctgtggagaagtgagagatctgaatttggagaggacatggggaagaatcaatcttcaacagataatctttaagtacagacccaggaatatcagatctgaagtggcaccatcttttctgtcttcctgacaaacttccatcaacccaaaaagttccagttgcaaagatccaagaaaactcagtaaagatcactttggaatcactttgttgtaacaaaattgattcatggtgactctaatatttgtgtaaatctgctgaagaaaagtaactagaaaattcatacaacatcagtggttacagctatactaaaataaaactttatatgctaattatcttcaagggtctttctaaaataaaaggggttgttaggctactgcaaatataaagagacataatcacaaatctatttatatagatataaataattctaaacttaaaatcactagaattatagcttaaatattatgaaatgtacttagtcaacttaaaaacttacaccaaaaatctgtagtttagagtgtaagaagtaatgggtacagagaaaaaaaatttaagaccaatattttaacaggataatttggttattactcactatagtaaaacacttgcccttcttccttttccactgtatatgccagtcacaatcttgatcatttatatgaatgaaactcccttttaaacctgttaacttgaaggagaacagaaatggtattacttcaatagtggtagatttccacaaatcagacacattattttcttctgaacttggcaatataacctaataaggcagaataagtttctgttaaaatacttattctcaatatttatgtataaaccatgcttctcagctttcaaatttcaagataaaatttaagtattcagtaaaatgatggttaacatgttttaaaaaatctttaatggagaagttaaatatttggtgagattttagtctggctataaatgctttgtttgatatatatatgtgcacatatatatattacttaaccatatgaattttatttccttattctgaatatacttgtagttttacttctttctgtttatgtacccaattccttatgattattttgtttcttctgcaatatcaagatgttatttattttgagaaatgcttatttttatgactatttattccaatgttttaacaagaagcacagagatttatagtattcttaatagtatgtgcagaagttacatcatttaaaaaacccttgctgtaaagtaggataacttgaatattcattctaataattagactaagtgaaaatctgagaaagagttaattgcaatgtgatagtgggtagaaaggagagaaaaacccactgaagggttcaaatacatgtgaattctactgctttaagagaaataaaacaaataagcctagggaaatattagagtctaaaaaaccctagagttactctcttttgggaacataaggaggtatacagaactgcagacctctaaacataagtaggaaaaagaaaaataaaagaatattaccaataattaaaggtgccagatcaaaatagtaataaatcaacaaataatttttgattgactggtggaattagatttactaaataaaaatggcttaaattttgactgtactaactataaatgtaatgaattataataattataaatggtataaatgcattctacaatgtgattattttctgtattttagtatatagtataaaatggaattattgggttaaagtacttttattacatttcttaatccattgtttttacctaataaaatttcctcctctatattccaaagtta

SEQ ID NO: 364124 - DNA, 733 bp, Homo sapiens
ctacccttgagaggggcaagaggggtggtcaagccgccgccgccgcgacggcccccgcggtgcgggttgcgccagcctcctcggagctcgacgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtaagtatttgccagttgtggggctatttgcgcaactttggcccaggccggagggcgacgggccgcgggcctggcggagtgcggggccggaggggcgccgatccgtgcggggagccggagcgcggcggacgcgctgcgaggacccggtgacgggcggctgccaggccgcctgcttgttgccggcgcgtcaggtcccgggcgtgcggcctccctgagtcggaggcgaagcccctacggagactagttcccaaattagttaccttcttttc

SEQ ID NO: 364125 - DNA, 3419 bp, Homo sapiens
tgtagagtgggcgctttgcagaatacgtgttgaatgaaatcactgatctaggaaaagtaaaaattcctcaaatgaatacagaatacttgtgctactgctgatgatcaacactttatacagtgcctggtataccaaaggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattcattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgtagactacaagtggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactatcccgtttgcttttagtgagttaactactctttattcccccttattaatgaaattcatattcttaaattgacaagcttattaggcaagttaggtgcactgaatctaacctttaaggttgacatgggctcaaacttggcctaaaaagattgatgaacctgaggaaatttttataaatgaatatttcctataattgataaaatattatcatttaattatcacatttaaaacttatattaagtgtaaattccagtggctttacctcacttgaaaaattagtggggataagccattttgttttgtgatattaaatttaactatgatagttaattaaaaagacatatcttgtattcattaaaaatattttaatttaaaatattctgatttctaaagtgtgttagcttatcaattatttttgtttataaatagactttaatagctctctaagaatatgacctctaaaggaaaagatgattttttacaatacatacttctggaactttgagatttgagaaagcttccatgtatattgataaatctaataaaataaagagatcaattataaacctggttgttctataaaagtagagtgcacaaaaaaatgtcttgtgttttatactgtctaagatttggaggaaatgtggcaaattgcagtttatcgccatattttattatcatttttttctgtaaaagactataaaacttgaggattataaaataatcacagagtatatcaatggaaacagtttatcattttttcagttaaagtagtagtattgttagttgttgctgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctg

SEQ ID NO: 364126 - DNA, 3700 bp, Homo sapiens
tgtagagtgggcgctttgcagaatacgtgttgaatgaaatcactgatctaggaaaagtaaaaattcctcaaatgaatacagaatacttgtgctactgctgatgatcaacactttatacagtgcctggtataccaaaggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgtagactacaagtggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactatcccgtttgcttttagtgagttaactactctttattcccccttattaatgaaattcatattcttaaattgacaagcttattaggcaagttaggtgcactgaatctaacctttaaggttgacatgggctcaaacttggcctaaaaagattgatgaacctgaggaaatttttataaatgaatatttcctataattgataaaatattatcatttaattatcacatttaaaacttatattaagtgtaaattccagtggctttacctcacttgaaaaattagtggggataagccattttgttttgtgatattaaatttaactatgatagttaattaaaaagacatatcttgtattcattaaaaatattttaatttaaaatattctgatttctaaagtgtgttagcttatcaattatttttgtttataaatagactttaatagctctctaagaatatgacctctaaaggaaaagatgattttttacaatacatacttctggaactttgagatttgagaaagcttccatgtatattgataaatctaataaaataaagagatcaattataaacctggttgttctataaaagtagagtgcacaaaaaaatgtcttgtgttttatactgtctaagatttggaggaaatgtggcaaattgcagtttatcgccatattttattatcatttttttctgtaaaagactataaaacttgaggattataaaataatcacagagtatatcaatggaaacagtttatcattttttcagttaaagtagtagtattgttagttgttgctgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctg

SEQ ID NO: 364127 - DNA, 3646 bp, Homo sapiens
tgtagagtgggcgctttgcagaatacgtgttgaatgaaatcactgatctaggaaaagtaaaaattcctcaaatgaatacagaatacttgtgctactgctgatgatcaacactttatacagtgcctggtataccaaaggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgtagactacaagtggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactatcccgtttgcttttagtgagttaactactctttattcccccttattaatgaaattcatattcttaaattgacaagcttattaggcaagttaggtgcactgaatctaacctttaaggttgacatgggctcaaacttggcctaaaaagattgatgaacctgaggaaatttttataaatgaatatttcctataattgataaaatattatcatttaattatcacatttaaaacttatattaagtgtaaattccagtggctttacctcacttgaaaaattagtggggataagccattttgttttgtgatattaaatttaactatgatagttaattaaaaagacatatcttgtattcattaaaaatattttaatttaaaatattctgatttctaaagtgtgttagcttatcaattatttttgtttataaatagactttaatagctctctaagaatatgacctctaaaggaaaagatgattttttacaatacatacttctggaactttgagatttgagaaagcttccatgtatattgataaatctaataaaataaagagatcaattataaacctggttgttctataaaagtagagtgcacaaaaaaatgtcttgtgttttatactgtctaagatttggaggaaatgtggcaaattgcagtttatcgccatattttattatcatttttttctgtaaaagactataaaacttgaggattataaaataatcacagagtatatcaatggaaacagtttatcattttttcagttaaagtagtagtattgttagttgttgctgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctg

SEQ ID NO: 364128 - DNA, 1070 bp, Homo sapiens
  misc_feature (26)..(26): n is a, c, g, or t
  misc_feature (65)..(65): n is a, c, g, or t
  misc_feature (69)..(69): n is a, c, g, or t
  misc_feature (76)..(76): n is a, c, g, or t
  misc_feature (86)..(86): n is a, c, g, or t
  misc_feature (88)..(88): n is a, c, g, or t
  misc_feature (97)..(97): n is a, c, g, or t
  misc_feature (99)..(99): n is a, c, g, or t
  misc_feature (104)..(104): n is a, c, g, or t
ggaagttcctgaggacccttacccgntagcggagggtgtgaaatcagaacggccattgtattaantctntgaaganagactccggnantggaaacantngtctnttcctacaacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaaagccatgcagtgaacacagcacggggggaatc

SEQ ID NO: 364129 - DNA, 256 bp, Homo sapiens
  misc_feature (28)..(28): n is a, c, g, or t
gcggcgcctactactactatacggctgngagaagacgacagaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364130 - DNA, 526 bp, Homo sapiens
aaatatcccgtgaagaggaacaccgtgaatcacggagtagcgtcacggtgatgctatccgttcagccagaaaggctactcgattattctactttctgctgtctcgacaggaagtacgcgtctcgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccacgaggaactgggcgcttgcagtgcgttgcacaccctcacctcccacccactgattattaataaagtcttttcttttacctgccaa

SEQ ID NO: 364131 - DNA, 380 bp, Homo sapiens
gcagtgatgctgcggtgttctagaggatcccggcaccattgtgcgctcattcccggaactgggcgcggggctcgggctagttgctgaggcagctgctagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaaaaaaaaaaccagggttccggggcccgaatcggaacccagggccataggtgttcccggggtgactttgtt

SEQ ID NO: 364132 - DNA, 172 bp, Homo sapiens
gcggccgcctactactactactgctcgaattcaagcttctaacgatgtacggggacatgagcctggactgagccacgcgccgtcctccgaggaactgggcgcttgcagtgcgttgcacaccctcacctcccacccactgattattaataaagtcttttcttttacctgccaa

SEQ ID NO: 364133 - DNA, 1374 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaaagccatgcagtgaacacagcacggggggaatc

SEQ ID NO: 364134 - DNA, 1903 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggtagagccgggcccagggtgtcctccactgtgtgctccgggagtgggcaggggggaggaggagccctgccccaccttcaccatggccagtgcttcatgtgcctgacccgcagagctggcagctgagcagtgtggctctggggtgcagcccgggttggagctcagccctcgcctggctcttcttgcaggccctgggcatgttcagcgcagccttggcctcggggcagctgggccccctcatgtgccagttcggtctgcctgcagaggctgtggaggccgccaacaagggcgggtaaagtggctgcgcctgcacctccaggccagagccaggggcagggtccattcctgtccccctggatctgcagaagtggggctgagggggtaaaggtcacagcccttctgcccttgatcccatcgctttgatccccagttctgggcaagggttagacaccaccttgtgtctttaacgtgttctagatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364135 - DNA, 1244 bp, Homo sapiens
aaatatcccgtgaagaggaacaccgtgaatcacggagtagcgtcacggtgatgctatccgttcagccagaaaggctactcgattattctactttctgctgtctcgacaggaagtacgcgtctcgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364136 - DNA, 1115 bp, Homo sapiens
  misc_feature (17)..(17): n is a, c, g, or t
tttagtaaaatataganaagttttaaaaaaagcaggctgtaccgtccggaattcccggatgcggaggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364137 - DNA, 1519 bp, Homo sapiens
gctcgggcgggtctgccccgcggagcgggtcgccggggtggcgcgtcgaggctggtgccccgcggagacggcgtcaagcctagggccggccccactaggcttggcggggctgccccggcccagcgccgagtgcgggcggtgcgatcgtcgtgagcggggcaaacgcggaaaggcagcccggcgtgtctgagtctgccttaggcagctctgggcgcaggccccctgctcgcaaacaccccagggggcgggagcttgccggaccgcaggcgacagtgaccgccgcgtctcagcgtcctctccgcgctttcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364138 - DNA, 1202 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364139 - DNA, 1551 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagcggtgccctctctcttcgcagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364140 - DNA, 2166 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtaacgtgcgccacccgggctctcgggcagcttctgctgggaatgctttgaggcccggtctctgtttcctttaaacttctgctggctctgtctgcgtagtgtcggggagcctgtgtgtccgcaagctggttcccctttgggaatgcgcttgtttgcctgtggctagagctgggtaggcgagggcttctgggcccctggtgaggaccccagctgggtacttcagaggagggtggctggccgagcggtggggctggaggactggagggagctggggttcctgcgccctgggtcccctggccccacatggctgcctgcctgctgccagctcatggagtgcagacccgtgtgcttggcccttcagaaatgcttgtccctttgggtgggatctggactgaatcttctaatctaagcacatgaattgtgtaatgggatggaacagaaatgaccttgcttccagaacacagccgcaagtgtccacccgccccatgccgctcctccaggcctgtgggtccccaccgccccgcttcttcctggctttggtgttgggaattcctgctcctctggcctggggaggggccaggctctttctggtgggctagagggcatcctgagctcgcatttccttgcccctcgcaggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364141 - DNA, 1673 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactggaaatgcttgtccctttgggtgggatctggactgaatcttctaatctaagcacatgaattgtgtaatgggatggaacagaaatgaccttgcttccagaacacagccgcaagtgtccacccgccccatgccgctcctccaggcctgtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364142 - DNA, 2272 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcgggttcaggggcagccgagtgcggtgctcagcagaggcgcaggcagcgcggtggggcccgcgtggatctggctggggcaggcccgcctgagctgcagtgttttccaggtgagggtggcctgcagagcctgctgggaaacatgagccacagccagctcatgcagctcatcggaccagccggcctcggaggactgggtaacgtgcgccacccgggctctcgggcagcttctgctgggaatgctttgaggcccggtctctgtttcctttaaacttctgctggctctgtctgcgtagtgtcggggagcctgtgtgtccgcaagctggttcccctttgggaatgcgcttgtttgcctgtggctagagctgggtaggcgagggcttctgggcccctggtgaggaccccagctgggtacttcagaggagggtggctggccgagcggtggggctggaggactggagggagctggggttcctgcgccctgggtcccctggccccacatggctgcctgcctgctgccagctcatggagtgcagacccgtgtgcttggcccttcagaaatgcttgtccctttgggtgggatctggactgaatcttctaatctaagcacatgaattgtgtaatgggatggaacagaaatgaccttgcttccagaacacagccgcaagtgtccacccgccccatgccgctcctccaggcctgtgggtccccaccgccccgcttcttcctggctttggtgttgggaattcctgctcctctggcctggggaggggccaggctctttctggtgggctagagggcatcctgagctcgcatttccttgcccctcgcaggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364143 - DNA, 1739 bp, Homo sapiens
ggaaatagaagattctaaaagttagagaccctgtgagctccctgggtcactccccactcccaccttcacggggtaggacgggtctgcatcccaccgtcgcctcacttcaagtggtgccccctgtagggttcaggggcagccgagtgcggtgctcagcagaggcgcaggcagcgcggtggggcccgcgtggatctggctggggcaggcccgcctgagctgcagtgttttccaggtgagggtggcctgcagagcctgctgggaaacatgagccacagccagctcatgcagctcatcggaccagccggcctcggaggactgggtaacgtgcgccacccgggctctcgggcagcttctgctgggaatgctttgaggcccggtctctgtttcctttaaacttctgctggctctgtctgcgtagtgtcggggagcctgtgtgtccgcaagctggttcccctttgggaatgcgcttgtttgcctgtggctagagctgggtaggcgagggcttctgggcccctggtgaggaccccagctgggtacttcagaggagggtggctggccgagcggtggggctggaggactggagggagctggggttcctgcgccctgggtcccctggccccacatggctgcctgcctgctgccagctcatggagtgcagacccgtgtgcttggcccttcagaaatgcttgtccctttgggtgggatctggactgaatcttctaatctaagcacatgaattgtgtaatgggatggaacagaaatgaccttgcttccagaacacagccgcaagtgtccacccgccccatgccgctcctccaggcctgtgggtccccaccgccccgcttcttcctggctttggtgttgggaattcctgctcctctggcctggggaggggccaggctctttctggtgggctagagggcatcctgagctcgcatttccttgcccctcgcaggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364144 - DNA, 967 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaaggtaacgtgtgctgtcgcctggag

SEQ ID NO: 364145 - DNA, 289 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcagcgaggaactgggcgcttgcagtgcgttgcacaccctcacctcccacccactgattattaataaagtcttttcttttacctgccaa

SEQ ID NO: 364146 - DNA, 311 bp, Homo sapiens
gcagtgatgctgcggtgttctagaggatcccggcaccattgtgcgctcattcccggaactgggcgcggggctcgggctagttgctgaggcagctgctagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364147 - DNA, 1530 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364148 - DNA, 1589 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaaaaaaaaaaaaatcggggacaaagcggggcggacaaggggatgaaggccctggcaaaagt

SEQ ID NO: 364149 - DNA, 1427 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcagatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364150 - DNA, 1193 bp, Homo sapiens
ggacgcgtgggtcgacggacgcgtgggtccggacgcgtgggtcgacccacgcgtgcgaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364151 - DNA, 1438 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364152 - DNA, 1413 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364153 - DNA, 1636 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcgggttcaggggcagccgagtgcggtgctcagcagaggcgcaggcagcgcggtggggcccgcgtggatctggctggggcaggcccgcctgagctgcagtgttttccaggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364154 - DNA, 1702 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtaacgtgcgccacccgggctctcgggcagcttctgctgggaatgctttgaggcccggtctctgtttcctttaaacttctgctggctctgtctgcgtagtgtcggggagcctgtgtgtccgcaagctggttcccctttgggaatgcgcttgtttgcctgtggctagagctgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364155 - DNA, 1103 bp, Homo sapiens
ggaaatagaagattctaaaagttagagaccctgtgagctccctgggtcactccccactcccaccttcacggggtaggacgggtctgcatcccaccgtcgcctcacttcaagtggtgccccctgtagggttcaggggcagccgagtgcggtgctcagcagaggcgcaggcagcgcggtggggcccgcgtggatctggctggggcaggcccgcctgagctgcagtgttttccaggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364156 - DNA, 1022 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagcccccgaggaactgggcgcttgcagtgcgttgcacaccctcacctcccacccactgattattaataaagtcttttcttttacctgccaa

SEQ ID NO: 364157 - DNA, 807 bp, Homo sapiens
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaagcagcgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 364158 - DNA, 296 bp, Homo sapiens
gatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgtgagtgtccctgagccgcagcagcaggacaggcgacttctcgggccctcggagtcctcgctttggagttcgcggtgggggc

SEQ ID NO: 364159 - DNA, 375 bp, Homo sapiens
ccatagactggctctggccagtttacagaggctctgtgcttgagtgcctttatatccctgcttcaccttttgacttatgggcctaactgtaatgcatttaaatgcaaagtgaatatggaatgcatgtagcatgcatgtatgctcatcattcatgtgacctcttttatgattattcacagctcttcctataacctgttaaatatgtaatctttagccaacccgtgcaacataaagttcctgccccaacacttcctccttcaaagtgcctgctaacagtctttgctaaaggctaggcttcccagcctgtcagaatggccggccaccttataggctgcaaccttttataaaaaataaagtctcctttcttaatttata

SEQ ID NO: 364160 - DNA, 354 bp, Homo sapiens
tgggcaggaagggggactctgctgcccctggccttgcctgagagatcttggttgatggagctgttgtcatgggaatggagagagcccgaacaggaagagggtacagctttgtgcaggtcacatgcccactgcagccctccagcctctggtccccagagcggactttggaagctgaactgcttttgttgctggaagacttatgttataatttaccctgggtggaccagggtcgtacaaaaggttagtgtgtgtttgcagggtctgtttccaggcagggatgtcaggctgtgtgcttctaggtggggggtggatgtggatggcttctgcatgtagcgagggtgggcctggctctgg

SEQ ID NO: 364161 - DNA, 3294 bp, Homo sapiens
  misc_feature (3282)..(3283): n is a, c, g, or t
  misc_feature (3285)..(3285): n is a, c, g, or t
tgggcaggaagggggactctgctgcccctggccttgcctgagagatcttggttgatggagctgttgtcatgggaatggagagagcccgaacaggaagagggtacagctttgtgcaggtcacatgcccactgcagccctccagcctctggtccccagagcggactttggaagctgaactgcttttgttgctggaagacttatgttataatttaccctgggtggaccagggtcgtacaaaagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttctggagcctgtagttctttggggtggagggaagaagggaagggtgcctctcatctctgggtttagcctggcttggggaccccatacagaatgaatctgaactgccctctcctgtggctggtcaggtgcccccagcccacagagaggttaaaatctggagcaggaggcagcacatgggcctcatagcagtgactgcaggactaccagtctggttgggcaggcttgtttttgccatcttccccatcagcaaacattgaaccagggcccactcccgcctgccccagactggagacttttaggttataaggaataattcttccttcatgagccagcagtgggtaccagagtctcttgggctcagcacctgtttcctttcccacagaagggggtgcctgtcagaggcctggagccaaggccacctgtggctggacagcagcagccccctcagagtggggagcccacttctgccttctgcacgcgctcactcctgtgggtgccatcgcagtacgggggcctctgagtggccttgcaggtacagagtgccaccatgcgggtctcttgggccttgaacttgagtggagataggccagtgcgttggaagaagtgggagccgtcacagaagggctgcttcttgccgctcccnntntgccgaatt

SEQ ID NO: 364162 - DNA, 3314 bp, Homo sapiens
ctctccgcctgcaggctccggagcaggtgaccggatcttcccttggcccttctcccgccggttctcggaccactccctctggaaggaagtctctccgcccttcctcttcctccccgcccccgtcccgctggtgtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcacgggcgtccagtaacgcagtatcgattcgcttccccggcgtcggcctcaccgctactcccggcgtttccaagcctccctcctcgttctctccctcctgccggagccactgcggaccggagccccagcgccaggtggagccggggcgccagtgggagtcgggcccagccgtcttggcgctcgcccgactctcccgcccgcgcgcccagggaggcgcacaggcagcgcgcagcgcagggcgcgagcgaaaaatgcgggaatcagtgccaggcaggagaaaaggcgcgggcccaccttacagcccggcgcctcgtttcctagtccagtgtggccgctcgccttcggccggattattgtgtcccagacccggagccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364163 - DNA, 2558 bp, Homo sapiens
cccctcccctcccttccctccctccctcccatccccccctccccgagacccaccggaccccgaacccagcgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364164 - DNA, 2435 bp, Homo sapiens
actctgggtttctgattccacttccgtttcccagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364165 - DNA, 3160 bp, Homo sapiens
ctctccgcctgcaggctccggagcaggtgaccggatcttcccttggcccttctcccgccggttctcggaccactccctctggaaggaagtctctccgcccttcctcttcctccccgcccccgtcccgctggtgtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcacgggcgtccagtaacgcagtatcgattcgcttccccggcgtcggcctcaccgctactcccggcgtttccaagcctccctcctcgttctctccctcctgccggagccactgcggaccggagccccagcgccaggtggagccggggcgccagtgggagtcgggcccagccgtcttggcgctcgcccgactctcccgcccgcgcgcccagggaggcgcacaggcagcgcgcagcgcagggcgcgagcgaaaaatgcgggaatcagtgccaggcaggagaaaaggcgcgggcccaccttacagcccggcgcctcgtttcctagtccagtgtggccgctcgccttcggccggattattgtgtcccagacccggagccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagttggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364166 - DNA, 2948 bp, Homo sapiens
ctctccgcctgcaggctccggagcaggtgaccggatcttcccttggcccttctcccgccggttctcggaccactccctctggaaggaagtctctccgcccttcctcttcctccccgcccccgtcccgctggtgtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcacgggcgtccagtaacgcagtatcgattcgcttccccggcgtcggcctcaccgctactcccggcgtttccaagcctccctcctcgttctctccctcctgccggagccactgcggaccggagccccagcgccaggtggagccggggcgccagtgggagtcgggcccagccgtcttggcgctcgcccgactctcccgcccgcgcgcccagggaggcgcacaggcagcgcgcagcgcagggcgcgagcgaaaaatgcgggaatcagtgccaggcaggagaaaaggcgcgggcccaccttacagcccggcgcctcgtttcctagtccagtgtggccgctcgccttcggccggattattgtgtcccagacccggagccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaacctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364167 - DNA, 2176 bp, Homo sapiens
ctctccgcctgcaggctccggagcaggtgaccggatcttcccttggcccttctcccgccggttctcggaccactccctctggaaggaagtctctccgcccttcctcttcctccccgcccccgtcccgctggtgtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcacgggcgtccagtaacgcagtatcgattcgcttccccggcgtcggcctcaccgctactcccggcgtttccaagcctccctcctcgttctctccctcctgccggagccactgcggaccggagccccagcgccaggtggagccggggcgccagtgggagtcgggcccagccgtcttggcgctcgcccgactctcccgcccgcgcgcccagggaggcgcacaggcagcgcgcagcgcagggcgcgagcgaaaaatgcgggaatcagtgccaggcaggagaaaaggcgcgggcccaccttacagcccggcgcctcgtttcctagtccagtgtggccgctcgccttcggccggattattgtgtcccagacccggagccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatgga

SEQ ID NO: 364168 - DNA, 1710 bp, Homo sapiens
ctctccgcctgcaggctccggagcaggtgaccggatcttcccttggcccttctcccgccggttctcggaccactccctctggaaggaagtctctccgcccttcctcttcctccccgcccccgtcccgctggtgtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcacgggcgtccagtaacgcagtatcgattcgcttccccggcgtcggcctcaccgctactcccggcgtttccaagcctccctcctcgttctctccctcctgccggagccactgcggaccggagccccagcgccaggtggagccggggcgccagtgggagtcgggcccagccgtcttggcgctcgcccgactctcccgcccgcgcgcccagggaggcgcacaggcagcgcgcagcgcagggcgcgagcgaaaaatgcgggaatcagtgccaggcaggagaaaaggcgcgggcccaccttacagcccggcgcctcgtttcctagtccagtgtggccgctcgccttcggccggattattgtgtcccagacccggagccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggccgttggattcttgccagaagcttcctggagataattttaactagtaccttattgaagaaaagttgtcctagctaatgaaagaatgcagctcagcatcttgaagacggggcaagccttcctcatctccccacatcccacagtttcttatacccactgaattaaactgaaaaatgaagaac

SEQ ID NO: 364169 - DNA, 483 bp, Homo sapiens
atcagcccagaagttcatttcaaggactcacatctgaaatctcagttctttcttgaaatggctgaaattttatgccctgaagacgcggacaccccttgtttgcactgtgggcttggcagcaggggggtgggactcagaggcatcttgaacacgctggcttttgtcccccactccatcggggagcttgggactcagggctgaccttctgcattgtacatgacactggcctgtctcacacaagatccagcttccctcaacagtgcacaaggacaggtaccacacgtgcagaacacacatcgccacattgggcctcggagcagggacagggtggaggaggagggatatctgagtctgagcagagggcggggaggctggtcctggagttggaagttggctctgactctcctctctctctccacacccccaagtctgcaaaacctgcatcgtgcgctacctggagaccaacaaatactgccccatgtg

SEQ ID NO: 364170 - DNA, 2641 bp, Homo sapiens
tgggcaggaagggggactctgctgcccctggccttgcctgagagatcttggttgatggagctgttgtcatgggaatggagagagcccgaacaggaagagggtacagctttgtgcaggtcacatgcccactgcagccctccagcctctggtccccagagcggactttggaagctgaactgcttttgttgctggaagacttatgttataatttaccctgggtggaccagggtcgtacaaaagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364171 - DNA, 2699 bp, Homo sapiens
cctgcctttccctctcctggcctgtaaccctctggggattgggatgggggccggccgttcttcgcaagccccgatgggagggggaggctctgagccgatcctgccttcgcaccccccgcgccccgtcagtccctagcccagcttgccccgtccgcctttctttctcccttttttctgtccctttttccctttcctctcttccaagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364172 - DNA, 2466 bp, Homo sapiens
ctcagcagagcctccctccggaacacccctcccggggccccgcagaaagtttggctctagggaagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364173 - DNA, 3023 bp, Homo sapiens
tgggcaggaagggggactctgctgcccctggccttgcctgagagatcttggttgatggagctgttgtcatgggaatggagagagcccgaacaggaagagggtacagctttgtgcaggtcacatgcccactgcagccctccagcctctggtccccagagcggactttggaagctgaactgcttttgttgctggaagacttatgttataatttaccctgggtggaccagggtcgtacaaaagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttctggagcctgtagttctttggggtggagggaagaagggaagggtgcctctcatctctgggtttagcctggcttggggaccccatacagaatgaatctgaactgccctctcctgtggctggtcaggtgcccccagcccacagagaggttaaaatctggagcaggaggcagcacatgggcctcatagcagtgactgcaggactaccagtctggttgggcaggcttgtttttgccatcttccccatcagcaaacattgaaccagggcccactcccgcctgccccagactggagacttttaggttataaggaataattcttccttcatgtccccgtacatcgttagaagcttgaattcgagcagtagtagtagtagtaggcggccgc

SEQ ID NO: 364174 - DNA, 3441 bp, Homo sapiens
  misc_feature (3429)..(3430): n is a, c, g, or t
  misc_feature (3432)..(3432): n is a, c, g, or t
ctctccgcctgcaggctccggagcaggtgaccggatcttcccttggcccttctcccgccggttctcggaccactccctctggaaggaagtctctccgcccttcctcttcctccccgcccccgtcccgctggtgtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcacgggcgtccagtaacgcagtatcgattcgcttccccggcgtcggcctcaccgctactcccggcgtttccaagcctccctcctcgttctctccctcctgccggagccactgcggaccggagccccagcgccaggtggagccggggcgccagtgggagtcgggcccagccgtcttggcgctcgcccgactctcccgcccgcgcgcccagggaggcgcacaggcagcgcgcagcgcagggcgcgagcgaaaaatgcgggaatcagtgccaggcaggagaaaaggcgcgggcccaccttacagcccggcgcctcgtttcctagtccagtgtggccgctcgccttcggccggattattgtgtcccagacccggagccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaattgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctcttttttttttttttcctgtgtttgcaccttgtcctgtgtctgaggtcctgtgactgtaccctcctttgccctgggacatctgtatctcttggctttgtaataaatgctgcatactttctggagcctgtagttctttggggtggagggaagaagggaagggtgcctctcatctctgggtttagcctggcttggggaccccatacagaatgaatctgaactgccctctcctgtggctggtcaggtgcccccagcccacagagaggttaaaatctggagcaggaggcagcacatgggcctcatagcagtgactgcaggactaccagtctggttgggcaggcttgtttttgccatcttccccatcagcaaacattgaaccagggcccactcccgcctgccccagactggagacttttaggttataaggaataattcttccttcatgagccagcagtgggtaccagagtctcttgggctcagcacctgtttcctttcccacagaagggggtgcctgtcagaggcctggagccaaggccacctgtggctggacagcagcagccccctcagagtggggagcccacttctgccttctgcacgcgctcactcctgtgggtgccatcgcagtacgggggcctctgagtggccttgcaggtacagagtgccaccatgcgggtctcttgggccttgaacttgagtggagataggccagtgcgttggaagaagtgggagccgtcacagaagggctgcttcttgccgctcccnntntgccgaatt

SEQ ID NO: 364175 - DNA, 2075 bp, Homo sapiens
ctctccgcctgcaggctccggagcaggtgaccggatcttcccttggcccttctcccgccggttctcggaccactccctctggaaggaagtctctccgcccttcctcttcctccccgcccccgtcccgctggtgtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcacgggcgtccagtaacgcagtatcgattcgcttccccggcgtcggcctcaccgctactcccggcgtttccaagcctccctcctcgttctctccctcctgccggagccactgcggaccggagccccagcgccaggtggagccggggcgccagtgggagtcgggcccagccgtcttggcgctcgcccgactctcccgcccgcgcgcccagggaggcgcacaggcagcgcgcagcgcagggcgcgagcgaaaaatgcgggaatcagtgccaggcaggagaaaaggcgcgggcccaccttacagcccggcgcctcgtttcctagtccagtgtggccgctcgccttcggccggattattgtgtcccagacccggagccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 364176 - DNA, 576 bp, Homo sapiens
cagtcagtctgcatgagccactgtttctaataagactgtggatagagtgatataatcacctctaaccatatcaaatgttacacgtaagtttcagattttgagacatgagttgataagatttgaagttcaaagaccatgactttagtacttcctgagtaatcaactgaaatatgttttacatatgtgttttccaaattgctgaccattcattataagtgcttctgaatttaaaggaggtacttgatgtataggtaagaaattacctttaaattctggaggtctaccctcaaagtgtatacagaggtttaattggatgtaagacacaggatcacctttagggttctgtttttttgtctatttaataaaacccaaactgtagtatgctttacatgcctttagaatcatataaataaactgctgttaagtaatgttcccagttgttatgtttctgttacaggtgaaaagcaatcacggagttaaaagaagacaagctgaaatgatgcaggctgctcctatgttggaaatttgttcattaaaattctcccaataaagctttacagccttctgcaaagtagt

SEQ ID NO: 364177 - DNA, 463 bp, Homo sapiens
gttttgcaattttcagcctttttgtgctggattttcctcatctttgtggatttatctccctttggtctttgatgttggtgaccttcagatggggtttctgtgtggatgtcctttttgttgatgttgatactactcctttctgtttgttagttttccttctaacagtcaggcccctctgctgcaggtctgctggagtttgttggagttccactccagaccctgtttgcctgggtatcaccagcagaggctgcagaacagcaaagattgctgccttttccttcctctgggaagcttcgtcccagaggggcacctgccagatgccagccggagctcttgtatatgaggtgaaaagcaatcacggagttaaaagaagacaagctgaaatgatgcaggctgctcctatgttggaaatttgttcattaaaattctcccaataaagctttacagccttctgcaaagtagt

SEQ ID NO: 364178 - DNA, 3800 bp, Homo sapiens
atggagaaggaatgtatgaatggatgtgttcagcggacaaaagctgcagttgagttcccacagaagacttccgcattagctgtctgcttctgttttcttcatcatggatttcgcaccacccccattccggcctctccattgattcctcgatcatcccgccccctacaccgcccactcccgggcatccccattggctgcgtgcttctccggctctcaattcgctgtacgtcatccgtgcatggctgcccattggccctctgcaatacttgtcttcatctcaccgcctatgcccccgtgagccgtacccctccgcgctggccttcccattggctgcccgccccttcaggccctgcccccgccggtcccgccgccggtgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctccccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaaca

SEQ ID NO: 364179 - DNA, 1824 bp, Homo sapiens
atggagaaggaatgtatgaatggatgtgttcagcggacaaaagctgcagttgagttcccacagaagacttccgcattagctgtctgcttctgttttcttcatcatggatttcgcaccacccccattccggcctctccattgattcctcgatcatcccgccccctacaccgcccactcccgggcatccccattggctgcgtgcttctccggctctcaattcgctgtacgtcatccgtgcatggctgcccattggccctctgcaatacttgtcttcatctcaccgcctatgcccccgtgagccgtacccctccgcgctggccttcccattggctgcccgccccttcaggccctgcccccgccggtcccgccgccggtgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtctgctggagtttgttggagttccactccagaccctgtttgcctgggtatcaccagcagaggctgcagaacagcaaagattgctgccttttccttcctctgggaagcttcgtcccagaggggcacctgccagatgccagccggagctcttgtatatgaggtgaaaagcaatcacggagttaaaagaagacaagctgaaatgatgcaggctgctcctatgttggaaatttgttcattaaaattctcccaataaagctttacagccttctgcaaagtagt

SEQ ID NO: 364180 - DNA, 1664 bp, Homo sapiens
atggagaaggaatgtatgaatggatgtgttcagcggacaaaagctgcagttgagttcccacagaagacttccgcattagctgtctgcttctgttttcttcatcatggatttcgcaccacccccattccggcctctccattgattcctcgatcatcccgccccctacaccgcccactcccgggcatccccattggctgcgtgcttctccggctctcaattcgctgtacgtcatccgtgcatggctgcccattggccctctgcaatacttgtcttcatctcaccgcctatgcccccgtgagccgtacccctccgcgctggccttcccattggctgcccgccccttcaggccctgcccccgccggtcccgccgccggtgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtgaaaagcaatcacggagttaaaagaagacaagctgaaatgatgcaggctgctcctatgttggaaatttgttcattaaaattctcccaataaagctttacagccttctgcaaagtagt

SEQ ID NO: 364181 - DNA, 658 bp, Homo sapiens
acctcaagtggtctccctgcctcggcctcccaaagtgctggaattacaggtgtaagccaccacgcccagccgaaaagatgggttcttctatcttttctctttccatagccaggaatgtatcctaaagaaatgatacaagtgtcgataaaactatgcccaatgctgtttgctggtttgctttgcaacctctaaatgaaagaacttagctgctcagtaggaagggaatggtatgatatgagtattaagcagccatttgaaatgtttgcaaaagtgtataatgatgtttcttactgttaaatggacaaagctagctgtgaaattatgtctgtagaatctaaatgatttcgtagaatatctggaaggaaattttccagaatggtaacagtagttgtctctggctgatgtgtgattgtttttcttgcttctttagactttcctgtattttgcgaattttctataatgaggctgtaggacttttaggatgaggggataaacaaaggcagcagaagagaaaacagcagctgtcaggtgaaggtgggctagcacagaggctcagaaggtgccagtgggtggcagaagtgacctctcagggtattattagatccatgtactctctcctctgccctgcaggcctgccgaggaggaactgaagacgaag

SEQ ID NO: 364182 - DNA, 1704 bp, Homo sapiens
atggagaaggaatgtatgaatggatgtgttcagcggacaaaagctgcagttgagttcccacagaagacttccgcattagctgtctgcttctgttttcttcatcatggatttcgcaccacccccattccggcctctccattgattcctcgatcatcccgccccctacaccgcccactcccgggcatccccattggctgcgtgcttctccggctctcaattcgctgtacgtcatccgtgcatggctgcccattggccctctgcaatacttgtcttcatctcaccgcctatgcccccgtgagccgtacccctccgcgctggccttcccattggctgcccgccccttcaggccctgcccccgccggtcccgccgccggtgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtttctgacgttccgatgactggcaaccccgcagaagaaggtgaaaagcaatcacggagttaaaagaagacaagctgaaatgatgcaggctgctcctatgttggaaatttgttcattaaaattctcccaataaagctttacagccttctgcaaagtagt

SEQ ID NO: 364183 - DNA, 1639 bp, Homo sapiens
atggagaaggaatgtatgaatggatgtgttcagcggacaaaagctgcagttgagttcccacagaagacttccgcattagctgtctgcttctgttttcttcatcatggatttcgcaccacccccattccggcctctccattgattcctcgatcatcccgccccctacaccgcccactcccgggcatccccattggctgcgtgcttctccggctctcaattcgctgtacgtcatccgtgcatggctgcccattggccctctgcaatacttgtcttcatctcaccgcctatgcccccgtgagccgtacccctccgcgctggccttcccattggctgcccgccccttcaggccctgcccccgccggtcccgccgccggtgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcagctgctggagtttgttggagttccactccagagcctcttcacctcatatacaagagctccggctggcatctggcagtgcccctctgggacgaagc

SEQ ID NO: 364184 - DNA, 774 bp, Homo sapiens
gcggccgccgtcgtcgggcgaggaggcggatgcctggccgggacccaggccgagccccggatccaggatgggatctcctgctcctgttcctcccgctcctgcccacggcgggctgcgcgggacgtagcgcgcttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtctgctggagtttgttggagttccactccagaccctgtttgcctgggtatcaccagcagaggctgcagaacagcaaagattgctgccttttccttcctctgggaagcttcgtcccagaggggcacctgccagatgccagccggagctcttgtatatgaggtgaaaagcaatcacggagttaaaagaagacaagctgaaatgatgcaggctgctcctatgttggaaatttgttcattaaaattctcccaataaagctttacagccttctgcaaagtagt

SEQ ID NO: 364185 - DNA, 2512 bp, Homo sapiens
tctctggttcaggtagatattcataagttaaagcatgccttagtgtaatgtgcttgtatgaaatgcttctaaagacacccacagttttggactggagtatagtagagatgaagtgagaccatgtggtcatgaggaattgcttcaggatgactgcatgagctagttgataaacttaataaggcactgatttctaatatgcaaaataagattagtatatattcttctagtgaaatcttgtgacctttcttataaatgagataaatttatagataattctacatatttgtatgattttctaaagcacatggcagctgccatctcatttaattctcacatcaaccctatgaggtaagtactattatgatccttatgttatatagggagagagaggcagatacattggcttataaatattcagtaggactttttgtcttgataggaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaatttttagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaagtggtttactttgtagagtttacatggttttatgcgcacactaattgtaataaactatgccaaaccaaaaaaaaataactc

SEQ ID NO: 364186 - DNA, 2288 bp, Homo sapiens
gacatccctcctctctcaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaatttttagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaagtggtttactttgtagagtttacatggttttatgcgcacactaattgtaataaactatgccaaaccaaaaaaaaataactc

SEQ ID NO: 364187 - DNA, 613 bp, Homo sapiens
gacatccctcctctctcaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagcttctccagagccagtttcagagccacttcctccctgaagtatgtccccatgccccaggacgtcgtcgtcgcccccatctctgagaagaccctgcgaagcttcctgagcaggcggtgcggttgtgtactgcctgcgggtggcttctgtggctttcacatcagggttttccgcagtgcctgggacacctgagggcacccggggggaaagtcagtcaccacgacctgaag

SEQ ID NO: 364188 - DNA, 2084 bp, Homo sapiens
tctctggttcaggtagatattcataagttaaagcatgccttagtgtaatgtgcttgtatgaaatgcttctaaagacacccacagttttggactggagtatagtagagatgaagtgagaccatgtggtcatgaggaattgcttcaggatgactgcatgagctagttgataaacttaataaggcactgatttctaatatgcaaaataagattagtatatattcttctagtgaaatcttgtgacctttcttataaatgagataaatttatagataattctacatatttgtatgattttctaaagcacatggcagctgccatctcatttaattctcacatcaaccctatgaggtaagtactattatgatccttatgttatatagggagagagaggcagatacattggcttataaatattcagtaggactttttgtcttgataggaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcgaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaagtggtttactttgtagagtttacatggttttatgcgcacactaattgtaataaactatgccaaaccaaaaaaaaataactc

SEQ ID NO: 364189 - DNA, 551 bp, Homo sapiens
gacatccctcctctctcaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcaggttaactccgttgactgccaaaatagcatccccaacgtgcagccctccgcatctatcagcaggttgccccggatggatctcagagatgaggattggaacaccatgttctttcccaccctaacaacaacaaagggcagtaaattaaagtactctttgtaaggtacag

SEQ ID NO: 364190 - DNA, 917 bp, Homo sapiens
cggggtttcactgtgttaatcaggatggtctcgatctcctgacctcgtgatccgcccgcctcggcctcccaaagtgctgcgattacaggcatgggcatgagccaccgcgcctggccggaaactggcttttaaatggggagaagtgaagcatgaactgtagctcctttcagacttgggaaggcccttctccctgggcactggttgcctcactgggaagatgagagtgccagcctctcaagagctcctttctgttctgatattccaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaac

SEQ ID NO: 364191 - DNA, 2074 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaac

SEQ ID NO: 364192 - DNA, 850 bp, Homo sapiens
aattagtaagcaatatattcctcatcttgcaaagaaattcaaattatggaaatgctttaaatgagcaactattaaaattatagactaggaaggaactgataaaactggtacttttcattcaagtagtgtaatctaacacaactctggaagtaacttggaaccaaatttttatcctctgctgtaggaacttattaattttctcaaaacaatataaacgcagacattcattgcagtattttttatagtagtgaacatttcaaacttactgcccaacaatagggaaatggttaagtacatcagctcgcttatccctcttccttttttctcctctcccaccaggctgaggactccctctgcttctcccttacaccaggaatgaacctttccttcccactcagaggaggttctgagaggactgaggtgggcaaaccactgaggatcttcagtgggggcagagaaagggctcactgagatggggggcaacgctatggcctcagcttctccttggcgtcgtgtgcatgtgttcctgaagccgaaacggaatttaacaggtctgggtcccagatccatttccatgactggccatgggctatctatgatctgtcaaaaggggacttggattcaagctctcagatccccttccaatctaaaacagattctttttttaaaaaaaatccaaatgtgattacgtcacttcagactaaaaacttccaaaggcttcccccatttgctctgaggatcaaggccagggcaaatgggagctcactgcagcctcaacctcctgggctcaagtgatcttgatcttcccattccagcctcctgagtagctggactacaggcgcatgtcccc

SEQ ID NO: 364193 - DNA, 2212 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaaggcagggaagttcagcatcattcccaccatcatcaacgtgggctctggggtggcgctcatgggtgctggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaac

SEQ ID NO: 364194 - DNA, 1924 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaac

SEQ ID NO: 364195 - DNA, 2005 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggctgaggactccctctgcttctcccttacaccaggaatgaacctttccttcccactcagaggaggttctgagaggactgaggtgggcaaaccactgaggatcttcagtgggggcagagaaagggctcactgagatggggggcaacgctatggcctcagcttctccttggcgtcgtgtgcatgtgttcctgaagccgaaacggaatttaacaggtctgggtcccagatccatttccatgactggccatgggctatctatgatctgtcaaaaggggacttggattcaagctctcagatccccttccaatctaaaacagattctttttttaaaaaaaatccaaatgtgattacgtcacttcagactaaaaacttccaaaggcttcccccatttgctctgaggatcaaggccagggcaaatgggagctcactgcagcctcaacctcctgggctcaagtgatcttgatcttcccattccagcctcctgagtagctggactacaggcgcatgtcccc

SEQ ID NO: 364196 - DNA, 2146 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaac

SEQ ID NO: 364197 - DNA, 1125 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggagtgagtggctgcagcctcaggaccctgaggggtttcccagccccgtgcggtgggtcccagcctgagggtggagtcctgcccactctgggagcctcacgctgagggaggagtcaggctgtcccagcgaggcccgacggcctccccagcatgagcaaattaactgtcctgggcagaggctccaggggacccaaggaacaggcctcacactggcccaggcctgggggaggggcacaggggtggggcctcctggacaggctgttctgggttggttttcagggagccattcctgaaggaggccgaagacttcaccattttcataaagaaccacatccgtttccccaaattcaacttctccaa

SEQ ID NO: 364198 - DNA, 2198 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaacaaaaaaccaaaaaaaataaaaaacggccgaagcaaaaatcccacagggcccc

SEQ ID NO: 364199 - DNA, 1990 bp, Homo sapiens
gaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaaggcagggaagttcagcatcattcccaccatcatcaacgtgggctctggggtggcgctcatgggtgctggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaac

SEQ ID NO: 364200 - DNA, 796 bp, Homo sapiens
acaggcaggccgtggcagcgggcgagggtggccctgcaaagtcacctgcccccagggactcagtgttttcagaactggctgtggcacacaggcaggccgtggcagcgggcgagggtggccctgcaaagtcacctgcccccagggactcagtgttttcagaactggctgtggcacacaggcaggctgtggcagcgctcagaccacgggcagtcagtgagagccagacctggcacctgctgtgcggttctgagtccttggggcaccagccgaaggtgaggcagagggaccccctttggcacatgctggctggagtgtgaagtgcctgtccagagaggcctaccctgtgcggctcccttctccctgaagaacgagggaggcagccctgaggcagggacgacgcagtgttctcagccgctccatggggggactaagcctcctggagggtggtctcgaggggctgacctcgtgcctgagcacctcctcctattgtccagtgccggtgaagggctggcctgggatgctgtccgtctccggaaagctgtgtgtgctgaccctcatctctcttttatcaagggtggcgtgataggaattaatattgaatggaactgtgatcttgataaagctgcctctgagtgccaccctcactattcttttagccgtctggacaataaactttcaaagtctgtctcctccgggtacaacttcaggtaaccgctgccttgtgcccacttgtgacctgaccatgatcagtggcactcactcatctgggtgccagcactattgaggccccttcctg

SEQ ID NO: 364201 - DNA, 1991 bp, Homo sapiens
gagcaatcccttctccctcctcctcctccccccgctactatccgcggcccagagaactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364202 - DNA, 386 bp, Homo sapiens
tagcatggcccctgcgcaaggatgacgcaaattcgtgaagcgttccatattcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364203 - DNA, 1949 bp, Homo sapiens
ccccacacagatatacgctaagtacgagctcgggttaattcagcacaggaccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364204 - DNA, 3233 bp, Homo sapiens
  misc_feature (5)..(5): n is a, c, g, or t
  misc_feature (1338)..(1338): n is a, c, g, or t
ttttntttccttatattgctgacttttgctcccctccttcaagaaacagcagaacacatcacctaaccacttcctttcatattcaacttggtggcagccgtgagaagagcttaataaaggcacctcaggctttttctggattggttctcatcttgccttttgatttttaccgacagtccaaaccaaaggacagcgataaagaaggaacttcaaattccacctctgaagatgggccaggggatggattcaccattctgtcttctaagagccttgttctgggacagaaggtaacaaagagaattgccttgtgctatattaaaacaccactgtatttttataacctactgtttacaagcaatgatgcctcctttcctcccctgataatgattttcactgcagtcttgaattattcatttttaaactaaagagctgtggcagtgtcagcattgtgagagtgagaattgttcttttttgctgagaattgttaacgctaacattggtcagacaagggtgagcatggaagctctttctggtcagtagataggatggcattactggttttgctgggaattccccacaccccagttatttctacatctgccaaaaaaaaatccatagctaactttctcagacagcttctgagaggcccatcttacatggttcaatgtaatttatcaaagaaagaaaatagaaatatatgtttcccaaatatccttggtattagaaatgaattatttgccaataattcagtctgcctgccttcctaggctttagaaagtaaacaaacagggctatgcatttgaacagtcttcagcaacacaacagcagcccaaccagacatgcaaataattcattcctacaagtgtaaagtttactgagcagacaatttatctaccaagtcaactggggctgaaataagacacccaaggaaagagtcagttaatcatatctctggtagctgaatgtttccatcttgacaacacagtaagcctccattcaaagaattgggaagagtatgttctaagaagagcatcggtgtggctggttgctaattcgtcactgatgaaagcagggaaacaaagaggtggaatttatgtcccctctctggcctgttcactgttacatgacgattagctttctctcacttagctaaggcaacataaaggtcttgctcacatgggccaacaatagagaatgccctccattccactctactgtgaacacataggatagcaattcccaatggtagccccaagactgtggtctccaaagggcaagggagccagacacccccaggtcagaatcccagagcccattacttctctccagcaaggttantggcttcagagccctgccccacagattttgtgttcttctagggagaatgcaggatgctgaggggagaagagagagcaagccctgggcttccttgcaggagcttctcagaagatgcatcactgaaaactaaggccaccagggttgggaaccaaaggcatgagctgtaagggaaagaaagaaaggagagggggccaggcgcggtggctcacgcctgtaatcccagcactttgggaggcagaggcgggtggatcaagaggtcgggagatcaagatcatcctggctaacacgatgaaactccgtctctactaaaaatacaaaaaattagctgggcatggtggcgggcgcctgtagtcccagctactcaggaggctgaggcaggagaatggcgtgaacctgggaggcagagcttgcagtgagccgagatcacgccactgcactccagcctgggagacagagtgagactccgtctcaaaaaaaaaaaaaaaaagagaggggaggccctgttcctgttccagggaagaagaaatggatttgttgcatgctgccagccccagagtggaaagcaaatccactgagctcaaagagcttattgcaagccaaacacctgggaaactggaggttgtcactctctatgcagcccctatgttgacattgggtatgaataattaaagagaattaatgaatgcaagtaaaatatgagatttttcaacagaattttatcttttccacattcaccaccttttcttcctaatgcagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364205 - DNA, 1877 bp, Homo sapiens
ctttcatggtcattctaagacatgcacgtacacggagcagcaaaacatcttagtcgccacaagcacaccttcccagctgagactgctccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364206 - DNA, 1848 bp, Homo sapiens
tttttttttagagacagggtctcactctgttgcccaggctggggtgcagtggcacaatcatagctcactgcagccttgaactcctggctgggctcaagcgatcctcctgcctcggcctcctgagtagctgggactaacttgagttctcttacgcttcctggatttctttccaggccgagacatagaaatcacaaatgaatgaatgtgatcaaacttgaaggccatttctaaagaaaagctttagctcaggccccattctgtgattgcctgttaatgcctccttgtgatttcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364207 - DNA, 1740 bp, Homo sapiens
gagcaatcccttctccctcctcctcctccccccgctactatccgcggcccagagaactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctttcatctcaagaatctccttgagctacacactctactttaatagatcctacatatgtataaaatcatgtctcatctagtactttctcattcattgtaatccctccatttatttaacaacttttttaatataccataattacatttatatctataatatttacttttacaaacattctcactattaaaacatactttataaattattcaatcatcaatttcatcctttattaaaataaa

SEQ ID NO: 364208 - DNA, 1262 bp, Homo sapiens
tgatgtgtccctttaactaggaaccattgtgaggaggtagcccaacccagggactacttggcagaccatatgaaaatggcgcatcagagcagcattaaacgcttctacccaaagcttgtgctaactgtgcaaagcaatacagcccagctcttgctctcgttaaacatagtccacatcaggagcacaggatgctgcccagccaacgtctctatcactgccttatctccagatctaacaggtacctgatgaggttaggctataacctaggaaaccttaggaaataacccgcggcattttctctcctatgtcccagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364209 - DNA, 475 bp, Homo sapiens
aaattttttttttagagacagggtctcactctgttgcccaggctggggtgcagtggcacaatcatagctcactgcagccttgaactcctggctgggctcaagcgatcctcctgcctcggcctcctgagtagctgggactaacttgagttctcttacgcttcctggatttctttccaggccgagacatagaaatcacaaatgaatgaatgtgatcaaacttgaaggccatttctaaagaaaagctttagctcaggccccattctgtgattgcctgttaatgcctccttgtgatttcagcggaaattctagaattggccggcaatgccgcgagggacaacaagaaggcccggatagccccgagacacatcttgctggcagttgccaatgacgaggagctcaaccaggtatgtctgaagccttgagggaagccgtagaatgggtttgccaaacatgctaatgtgtgggcctggctggc

SEQ ID NO: 364210 - DNA, 1981 bp, Homo sapiens
atccttattaaattaatcccctcccccccccccccacccgagagaactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364211 - DNA, 1976 bp, Homo sapiens
aacttattaggaaccatacagaaatggcgacagcaggtcctgacgctcagggtacacgtgagacagtggtgcgatcacacatgcctgccgtacgatgatccgtggtcatgaatagtgcctgtggagtctcgtcgaacaagtgaaggaagacgcccgcgaggattgcgttacgtgcctgagaagagcactcctgagttcgaggttcgtcgtagagctagagtgtacatgtgatcgtatcgatcgatcgaggtccgagagctgagcatcgaatataaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364212 - DNA, 1919 bp, Homo sapiens
gagcaatcccttctccctcctcctcctccccccgctactatccgcggcccagagaactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgataaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364213 - DNA, 1540 bp, Homo sapiens
ttctgtatcaaaaaaaaaaaaaaaaaagaactgtatgaaattgggaactagcaggctgtttgctacatgagcgcatgcatttctctcttcagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttaaaaaaaaaaacttt

SEQ ID NO: 364214 - DNA, 1380 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364215 - DNA, 1011 bp, Homo sapiens
tttaaaaaaaaaaaaaaaaaggcaggggtgtgattggttggaagggtagagaacaaaccccagaacagtgtaagctccagaggtgggtgatgggaacagtccccaaagtgagaagagggaataggtcagggcaatgcttgcagcatcaagttcctcaggagtttctgtcggcccagctcatagtcctcctcgtctacatttaccagcagcttgatggcttcatggcccacagcttgcttgagggagtctgtgatgaagacacctttaagtgcctctaataaagagccattgatgtagtcacgccagaatgcatcgaggtaggtgagctcagagaacttgatgtcacagatgatggagcccaggtcccgggacttgaggatggtgttggcctggttaaagcgctcaaactggcgctcaagtgggtcctgcttgttagagaagacattgccctgcagagcagtctcatgctggcagtattcagcccgaacccgcagtctgatgtcacatgtctgcttctccttgggatctggtgtcactgacttccggcgttttcgctggctcccaagtgtggctctccctcgggctggccgcttgctacacatctgaggacccgaagtggggcaacacaccacaggatagtggggaggcactgttttagagggctggggaggccttggttctggatcactgagggctctgggggtcacatagcgaattgatgtctcctccagatacttgtctacaagatcagggcacaagcccgtctcctcttgagggtgacgtagggcagcaggtcgtggcgagtgatgatgcgcagcagctgcagcaccatgctcttctggccacacctggcttgcccgccgctttaggcccgccatgctgggggctcaggtacgcaatgctttccagaatccctgctcagcagctgcaatccccaccgtactccgcaagaaacttaatttcccaggtctcttctctcggctcaggctcggcgccgccatgttggatccc

SEQ ID NO: 364216 - DNA, 2063 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctacgctgatcgatacagtcgt

SEQ ID NO: 364217 - DNA, 2239 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggtaacacgttttgttgtgtcctcagtgcctggcacttagatgctcagtttgttaaatggatagtgggagacacaggagtgtcaactatccacacatttgattggtgagccctactagccctgggtcaacgtgccctgtaagagcatgatcaaaaggaagtccagctttcctgcctctccacttgcaccccttagcattaaatttgcttccctgtgctatgaaatctgagaatcctgcctatgctgttcacaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364218 - DNA, 1754 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364219 - DNA, 1426 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364220 - DNA, 1333 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364221 - DNA, 1853 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364222 - DNA, 2117 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364223 - DNA, 1273 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364224 - DNA, 1241 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagatgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364225 - DNA, 2365 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcatgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364226 - DNA, 2314 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaccaggcctctgccttgcccgaatagaccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364227 - DNA, 2292 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggtaacacgttttgttgtgtcctcagtgcctggcacttagatgctcagtttgttaaatggatagtgggagacacaggagtgtcaactatccacacatttgattggtgagccctactagccctgggtcaacgtgccctgtaagagcatgatcaaaaggaagtccagctttcctgcctctccacttgcaccccttagcattaaatttgcttccctgtgctatgaaatctgagaatcctgcctatgctgttcacaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364228 - DNA, 1231 bp, Homo sapiens
tctgccctgtcaggtgataaatttctccctcgaggcctctatacttttgctggtggtgtgggccccattgtggtccccccccgcacgatcgagggtgcccttcgcaggctccccccggtgcgcctttttcccctctacacacgttttttaaaccgccgcgccctcgtctcttgttcttttaaattacgcgcctccctcgttaggggccccccctgtgtccacaaaccaacccggggcgcgattgggcccccccgggggaattttttcgccccccccccttttttttttttttttttttttttttttttttttttttttttttttttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364229 - DNA, 1438 bp, Homo sapiens
  misc_feature (518)..(518): n is a, c, g, or t
ccgcccccgggagaaaaaatatgcttgcaccataattattatcttcctctgtttgcccacaattttttttagtcccgctcgagccataattattccccttttttgtgttgacaccaccgcttaatagaccgccccgtcaaaatttgtaatatatttcccccttgaaggctctttataatatctccctctagtggggaggttttgttccccacccagtattgttgctgctcccccccccgcgacattatgggtttctccttggtccccgaagggctctcctcactggtagacacgcggttttccccgcctctcaccgacacgccttttgttataaaccccggcgcgccgttgcgcgccgttgctttataataatgccgccgcccctattatggggggcccccctgtaaaaaaaaacgcggggagagccgcaaaatctggggcccccccggggagaaattctttgaggcgcgcgccgccccccctctctttttttttttttttttttttttttttttttntttttttttttttttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364230 - DNA, 981 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggcccagagccatggctatctcctcctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364231 - DNA, 1254 bp, Homo sapiens
  misc_feature (688)..(688): n is a, c, g, or t
cttgctgtcttctgcttctctcccccctgtccgcctcctcccctcccccgtcgttcctctctcttccttccctcgctcctcctctctcctccctccccccggcggctggctttcctctctgtttgctctctctccccctcgctgtttgtttgcggtttctcgttgcctctcccgtgtcctgcttggtgtttgtggtttgtcgtttggtgttctttgttttttgtcttgttttgctggtcgctctgtctggtcgcgtgtgtgtgttgttcggccttttctcgttttgtttcttcgtctttcttgtgtttttttttgttcgtctcctgtgtttcctcctttttatcgtgcgtgccctcgctgcttttactctccgctcctccccttctctgcgtcttcttgttctgttctcgttctccctcccccttcgtgttgttccctcgcggttgtttttttgtttttggtggtcgccccgccctcttgttgtttctctctgctgtttttcttcttgtccccgtttcctccttcgtgttcttcctccttctgtgttcccccgccccccccgggctgtcttccttcctcccctgccgcccgcccccccccccgcgtgttttttttttgttttttttttttttctctttgtcttttttctttttttttttttttttttttttttttttttttttttttnttttttttttttgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364232 - DNA, 853 bp, Homo sapiens
[374 bp omitted]tggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcac

SEQ ID NO: 364233 - DNA, 2198 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364234 - DNA, 1987 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364235 - DNA, 1287 bp, Homo sapiens
agcggcctgcgagttaccgcccactcgctgcggcgcttctggctccagaccgccctccggatcggaccctgcgaatggttttggctatatcttcatcaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364236 - DNA, 2760 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364237 - DNA, 2059 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagatgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacattt

SEQ ID NO: 364238 - DNA, 1527 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgcaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 364239 - DNA, 2460 bp, Homo sapiens
agcggcctgcgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggagcccgtctcctcttgagggtgacgtagggcagcaggtcgtggcgagtgatgatgcgcagcagctgcagcacctggcgaaagttactttcatcacagcggccctggcgctccagtgccaataagaagtcacgtccatttcggatgagtccacgctcgtggtcatcaatgacatcaacaaagaggaaagaaagcacgcgcacatctctgtgtgtcagatgagtgcccacgatgtcaaacatgcggtgcaggctgtacagcccatgttcctgctcaccatgctcttctggccacacctggcttgcccgccgctttaggcccgccatgctgggggctcaggtacgcaatgctttccagaatccctgctcagcagctgcaatccccaccgtactgaaagggcagggaaagaaccgatgagacactcaagggcaggaactagtctcatgcattcccatattcccagttgctaacaatgcctggcacagtatagtgctttatacatgtttattaaatttttgaagtgtttgtttaaaaataaacactggccaggcacaggggctcacacctgtaatcccagcattttgggaggccaaggcaggaggatcacttgagcccaggcgtttaagaccagcctgggcaacatagggagacccgtttctacaaaaaaagaaaaaattagctgggcttggtggtacacgcctgtagtcccagctgcacaggaggctgaggtgggaggaaggcttgaggccaggagttcaagatcagcctggtcaacatagcaagaccccatctctacaaaaaagaaaaaaattagcaaggcatggtggcatgtgcctgtagtccctgctactcaggaggctgaggcaggaggatcacttgagcccaggagttcaaggctgcagtgagccataatcctgcactgtagcctgggtgacagagtgagtcccccatctcggaaaaaaaagaactagtttaaattctgactgtatcactgaaaggctgtgtagctgtgtgaccgtaagcaagtcacttaactccagattctcagtgctgtcatctataaacagggatgaatgaatatacacctcagagttgttaagaatccaatgagaaaatcacgggtaacccttatataaatggttgtgaaacatttcaaagatacaagcatccttggcctttgcagcccagaatcatccctccacatttttcctacaatccaaccacatcaagaaatgataactgctcagaaagtttatcaatatttaccaaaactcatggatttaaaataaacattaagtttctacaataagcattcttgtaattctatgccatttgtactcccttgatcttcaccctatttggcaatatcaactttttttttttgagatggagtctcactttgtcacccaggctggagtgcagtggtgcaatctcggctcactgcaacctccgcctcccaggttcaagcaattctcgtgcctcagcctcccaagtagctgggattacaggcacgcaccaccacgtcttgctaatttttgtatttttagtagagatgggtttttaccatgatggtcaggctggtcttgaactcctgacctcaggtgatccacccacctcggcctcccaaagtgctgggattacaggcgtgagcca

SEQ ID NO: 364240 - DNA, 2933 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaagattggtctagctgtctgctatgacatgcggttccctgaactctctctggcattggctcaagctggagcagagatacttacctatccttcagcttttggatccattacaggcccagcccactgggagcccgtctcctcttgagggtgacgtagggcagcaggtcgtggcgagtgatgatgcgcagcagctgcagcacctggcgaaagttactttcatcacagcggccctggcgctccagtgccaataagaagtcacgtccatttcggatgagtccacgctcgtggtcatcaatgacatcaacaaagaggaaagaaagcacgcgcacatctctgtgtgtcagatgagtgcccacgatgtcaaacatgcggtgcaggctgtacagcccatgttcctgctcaccatgctcttctggccacacctggcttgcccgccgctttaggcccgccatgctgggggctcaggtacgcaatgctttccagaatccctgctcagcagctgcaatccccaccgtactgaaagggcagggaaagaaccgatgagacactcaagggcaggaactagtctcatgcattcccatattcccagttgctaacaatgcctggcacagtatagtgctttatacatgtttattaaatttttgaagtgtttgtttaaaaataaacactggccaggcacaggggctcacacctgtaatcccagcattttgggaggccaaggcaggaggatcacttgagcccaggcgtttaagaccagcctgggcaacatagggagacccgtttctacaaaaaaagaaaaaattagctgggcttggtggtacacgcctgtagtcccagctgcacaggaggctgaggtgggaggaaggcttgaggccaggagttcaagatcagcctggtcaacatagcaagaccccatctctacaaaaaagaaaaaaattagcaaggcatggtggcatgtgcctgtagtccctgctactcaggaggctgaggcaggaggatcacttgagcccaggagttcaaggctgcagtgagccataatcctgcactgtagcctgggtgacagagtgagtcccccatctcggaaaaaaaagaactagtttaaattctgactgtatcactgaaaggctgtgtagctgtgtgaccgtaagcaagtcacttaactccagattctcagtgctgtcatctataaacagggatgaatgaatatacacctcagagttgttaagaatccaatgagaaaatcacgggtaacccttatataaatggttgtgaaacatttcaaagatacaagcatccttggcctttgcagcccagaatcatccctccacatttttcctacaatccaaccacatcaagaaatgataactgctcagaaagtttatcaatatttaccaaaactcatggatttaaaataaacattaagtttctacaataagcattcttgtaattctatgccatttgtactcccttgatcttcaccctatttggcaatatcaactttttttttttgagatggagtctcactttgtcacccaggctggagtgcagtggtgcaatctcggctcactgcaacctccgcctcccaggttcaagcaattctcgtgcctcagcctcccaagtagctgggattacaggcacgcaccaccacgtcttgctaatttttgtatttttagtagagatgggtttttaccatgatggtcaggctggtcttgaactcctgacctcaggtgatccacccacctcggcctcccaaagtgctgggattacaggcgtgagcca

SEQ ID NO: 364241 - DNA, 1072 bp, Homo sapiens
agcggcctgcgagttaccgcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggtaacacgttttgttgtgtcctcagtgcctggcacttagatgctcagtttgttaaatggatagtgggagacacaggagtgtcaactatccacacatttgattggtgagccctactagccctgggtcaacgtgccctgtaagagcatgatcaaaaggaagtccagctttcctgcctctccacttgcaccccttagcattaaatttgcttccctgtgctatgaaatctgagaatcctgcctatgctgttcacagggaaggaggctttgccatctt

SEQ ID NO: 364242 - DNA, 1057 bp, Homo sapiens
gggccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgatatgtgagtattatcgttggaagaatactctcccttttcgtgtccactttattcttctccagttgttcctatgacaacatgactacaacgcaaaaaagaaaggacgaatctgcttgtttgaatgagaaataccaaattctagtaaaaccgtttgtttttcactttttgccgttaacgaaaaagtagctttacttgctaaggggaactgttgtgagtgtataaattatactttggcttgttggttagcttctgatttccatttctgatatggcatgggaattaaaatatcttactgctaga

SEQ ID NO: 364243 - DNA, 836 bp, Homo sapiens
  misc_feature (49)..(49): n is a, c, g, or t
gtaattatatattgtaatatcatatatacaaacacacgaatacttttantatgctccaatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgttattctgacctctaccctttgcccaaaacctaatacaccaagaaccctttattacaatatctaatcctccttccgcataatatcatattctctgctctttttttatccactcccttcttttatttatcgtaatctccttttacgtatattataataaatcttatttacttacttaataataatcactattatttcctaccgtataatacacatcagaaatctaatattcctcctactcctctctcgctccttttattattacaatataatatataatttaaatacaattcttattccagtatatagtctaaacatgtcataatcaatgatgcaatatcacctttacacgaacactcctaacaaatgacg

SEQ ID NO: 364244 - DNA, 853 bp, Homo sapiens
  misc_feature (853)..(853): n is a, c, g, or t
gctacacagacctactcaaagctcaacaaacttcctatccaccacccaaaccctatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaaataaaacatccaagagctatacctaccaacacctcacacccccccctagccagcccgcctctcttcacaatcccaaccgacactctttacgccacattagtctgcaatatatgtcaatcccaccaatttacttcctctacgggcaatactaagcctactattaggatggtttacctccatgttcccctacaccccccctatcctctatcccccttcacaacatcacatccctcctatcatttactaacaaactgcaccctcccccctcttatccgccccacaccacttaatataaaaatccattctccacccaccgaccatgcactcgtgtcattcgcccatacgcccccacagaagacggtatacctcccccctatcccacaccatatataattctttacgcacacgtcctaatccctatcatccctgcgcccccctccactactctattctaatagataagtcggtcaccaactcacatgtcaatcaacatacttcacatan

SEQ ID NO: 364245 - DNA, 1467 bp, Homo sapiens
atttatttgttcatttattttttgaaactgagtctcactatttcacccaggaggagtggcggcaactggaccctgatgagaagataacatacggggatgtgatgttggagaactacagccatctagtttccttgggtgaggatagcttgctttctgaatgctctcagttgaatggggttttatgcttgagtttgaagaaataagtgacaacaccacttaattccttgtgggcactagctgcagtgtttatattattcttcattgaaaggttctatctttgataaggtaaaaaatggagcatttctgttatgcagcttatgaggtggcaacatcttgtacttcagagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364246 - DNA, 1620 bp, Homo sapiens
gggccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagaccgagtctcagtctgtcacccaggctagtgcaatggtgcaattttggctcactacaccctctgcctcccagattcaagcgattctcctgcctcagcctcccgactgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364247 - DNA, 1287 bp, Homo sapiens
gggccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364248 - DNA, 874 bp, Homo sapiens
gggccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgatatgtgagtattatcgttggaagaatactctcccttttcgtgtccactttattcttctccagttgttcctatgacaacatgacatgttggccaggttggtctcgaactcctgacctc

SEQ ID NO: 364249 - DNA, 622 bp, Homo sapiens
acgtgttctgtgttgcgtagaaagagacttaagttctttggaaaatgtcttaactggtgggtttttaaccgtctaaaattttgacattcttttatactttgtttccatgatttgtctcgcattctctgcagggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgatgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364250 - DNA, 397 bp, Homo sapiens
tgacaggccctgtctcagaagcccagggtcaagcatgttcaatgattgggtaagtttggaaaagatcaggggaataagtggtggattccagtctaaaactagttgctacttgctctaacattgggtaagtgaacctttacaccatcttagagatgaggctcttccttccccctgtttattttatgagacagtctcactctgtcagccaggctggggtgcagtggcatgatctcggctcactgcaacttctgcctcccaggttccagtgattctcctgcctcagccttccaggtagctgggactacaggtacccaccaccacgcccagctaactttgtatttttagtagcgatggggtttcaccatgttggccaggttggtctcgaactcctgacctc

SEQ ID NO: 364251 - DNA, 315 bp, Homo sapiens
acccaccttggcctcccaaagtgctgggattatgggcgtgagccacggtgcccggcccacctgtctggctttaacaccgttctgttttcttccaagctgtcttgtcgacggtctcactgatgcctcttctgcattcaaagttcctcgacccgggccagatacactccagttcacagtggatgtcttccactttgctaatgactccagaaacatgtggtaagagctttaacagcctgaaagaaggctgaacttgcaaccttcatatcctactgaatggggtcactcactagctccacccctaagcaaatgacttag

SEQ ID NO: 364252 - DNA, 200 bp, Homo sapiens
agtttagcccactgaggcagaataaaacctccaacccagttcccggttagggactaagatgacccttggttgtgtgttctcctttcacagtgacagaagaagcagatgtcaccgtgggggccactgatcttcctggacaggagtggtgaccatgaagtagagcagtgggctttgccttctgacacctcagtggtgctgct

SEQ ID NO: 364253 - DNA, 366 bp, Homo sapiens
catgttggccaggttggtctcgaactcctgacctcaggtgatatacccgccttggcctcccaaagtgctgggattataggtgtgtgccatcgcacccggccccttctcactctttaaagggttgagggttataagagaactggtgtgttaaactcccaggcacagcctggaactcggcctggaaatagctgttattccttgcagaatatacatcacctgccacctgaaggtcaccctagctgagcaggacccagatgaactcaacaaggcctgttccttcagcaagccttccaacaggtgaggacaggtgctccgtgactggagtagaaactgaatcggcgaccccttgtctatttcccccaatat

SEQ ID NO: 364254 - DNA, 1516 bp, Homo sapiens
gggccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364255 - DNA, 1248 bp, Homo sapiens
cacgaactacgatttgcgccggcagctggaccctgatgagaagataccgtacatcggcgtgacgcacaggacgtacaaccacgtagtgactgtggcttatgaggtggcaacatcttgtacttcagagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364256 - DNA, 1105 bp, Homo sapiens
acgtgttctgtgttgcgtagaaagagacttaagttctttggaaaatgtcttaactggtgggtttttaaccgtctaaaattttgacattcttttatactttgtttccatgatttgtctcgcattctctgcagggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364257 - DNA, 1834 bp, Homo sapiens
gggccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcgtgtcgtgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaacccaataaagcccattattaatttcgccctcgtcgacctaagcggaggggctctcgctgcctgttgccttgagtacggcccccacactatgtcacagtccccgcattccggcgcccgggccccccgactccgcccgacgtctcacatcatatacaccgtgcatactgtcccacacacattctgggctatcctaaaagcttactctgatctagaggccttttcatcctcttcccttcagacgcactccctctctgtatgccaataggctccccatgtagctttctctctatggttacctactattaaatgtagtccacaacattcgttgagagacggtcaaag

SEQ ID NO: 364258 - DNA, 1249 bp, Homo sapiens
gggccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgagaagattttcgcgttctgcgataccaggtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaataaaaaatggtcgtggtgtg

SEQ ID NO: 364259 - DNA, 416 bp, Homo sapiens
tggaagacttggatttggtggaagacacagatttttctggaagacatggattagctggaagatctgtatttgatggaagaccttgaaattattggaagacatggatttcctggaagacgtggattttcctggaagatctggatttggtggaagaccagtaattgctggaagactggatttgctggaagacttgatttactggaagacttggagcttcttggaagacatggattgtccggaagacatggattgtctggaagatgtggattttctggaagctcaggattatctggaagaccttgagattattggaagacttgaagtcgctggaagacccggagttgttggaagaccttgacacaggtgccatcggaaaccctggatattggaaacattgtaagcacaggatattggag

SEQ ID NO: 364260 - DNA, 2024 bp, Homo sapiens
  misc_feature (161)..(161): n is a, c, g, or t
  misc_feature (173)..(173): n is a, c, g, or t
  misc_feature (220)..(221): n is a, c, g, or t
  misc_feature (228)..(228): n is a, c, g, or t
  misc_feature (1813)..(1813): n is a, c, g, or t
  misc_feature (1853)..(1854): n is a, c, g, or t
  misc_feature (1863)..(1863): n is a, c, g, or t
gaataaaaaagaagaaaaattggaagacatggatttcctggaagacgtggattttcctggaagatctggatttggtggaagaccagtaattgctggaagactggatttgctggaagacttgatttactggaagacttggagcttctggaagacatggatgnccggaagacatngatgtctggaagatgtgattttctggaagctcagatatctggagacnngagattntggaagacttgaagtcgctggaagacccggagttgtaggaagaccttgacacaggtgccatcggaaaccctggatattgcagacactggaagacctgaatgtcagaagatcagcacactggagacgttggaagacatggatattgagccagttgatggaagactgggtagttgttggaagacatgaagatgctggaagacacagagatgctggaagacgtggagatgttggaagacgagcagatgctggaagccctggagatgctggaagacctggagatataggaagacatggatttgttggaagacgtagcttagttggaagacatatattttctggaagacgtggattttctggaagacatggcttggttggaagacgtggattttctggaagacgtacctttgttggaagacatacctttgttggaagacgtacctttgttggaagacgtacctttgttggaagacacaagtaggctggaagacattaatttgatggaagacatggctttgttggaagacgtggatttgctggaagacacggatttcctggaagacctggatttttcggaagctatggatttgagggaagacaaggattttctggaagacatggatagtctggaagacatggctttgttggaagacgtggacttgctggaagacacggatttcctggaagacccggattttttggaagctatagatttaagggaagacaaggattttctggaagacatggatagtctggaagacctgaggccattggaagatgtggattttctggaagacatggcttttttggaagacgtagattttcaggaagacccaaattatccggaagacttggattgttgggaagacgtggattttctggaagactggaggttactggaagacatggattttctggaagacatggattttctggaagacgtggatcttcaggaagacatatattggctggaagacctggattttttccggaagatgtggattgactggaagacctggatttggtggaagacgtagatttttctggaagacactgactgactggaagacctggatttctttctggaagacactgattgactggaagacctggatttctttctggaagacactgattgactggaagatctagatttttctggaagaactagatttactggaagacttggatttggtggaagacacagatttttctggaagacatggattagctggaagatctgtatttgatggaagaccttgaaattattggaagacatggatttcctggaagacgtggattttcctggaagatctggatttggtggaagaccagtaattgctggaagactggatttgctggaagacttgatttactggaagacttggagcttcttggaagacatggattgtccggaagacatggattgtctggaagatgtggattttctggaagctcaggattatctggaagaccttgagattattggaagacttgaagtcgctggaagacccggagttgttggaagaccttgacacaggtgccatcggaaaccctggatattgcagacactggaagacctgaatgncagaagatcagcacactggagacgttggaagacatggatnntgagccagntgatggaagactgggtagttgttggaagacatgaagatgctggaagacacagagatgctggaagacgtggagatgttggaagacgagcagatgctggaagacctggagatgctgtaacctttgttggaagacacaaggtgctcacaagcatgggccaggta

SEQ ID NO: 364261 - DNA, 380 bp, Homo sapiens
tgaattcttcagtttgcctaaggaaaaaacatgctctgaaataaccacaattccataatcacacctaagaaaataaggtcgtaatagcatctattattactatgtaatatctcctcttatttgctttaatatagtaactcattagcagtgacataatattcatacagcagtgtttatcttcattacttgctttacttaatgaagacttaagccctttttacagccccattttctctcccctgtacgcccagtattattttattgctgctttagttgaatcattaaatagtattctcattattttgttagtgttccagctgtcagcctcattttctttttttttttttttttgttttttgttttttgagacagagtgtggc

SEQ ID NO: 364262 - DNA, 1153 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacaggggtgaggactgggtagagggctggggttcgaattgcccctgtgcccccaggctggctgtgtcacaagcttgggccaggctttttgcccctctgaacctcagttcccctgtctgcaaagtggagttaatggtgcttacggagttgtggaagggattaagtggaataacgatgcaagtaaagcgcttacatagcacaggtcctagcacagaataagcgtttaacagttgacagttgttgcttttctaagcctggatctgtgtgatacagtcgttattatccaagcctggatttgtgtgatattgtcataaggaccgtgggggattcagatccttgaccgagccctccttgttatcttttcctttttgtccctctgcatatattcatatctttttacttagcaccccccacagacagatttctgctgggagggaggggacgatgaagagatgcctaggtgacatccctgccttccaggcagttgttcctgacagtcactaggaatacaaatacagcctggctggggagacagacatgtaaacagattttatagccaatgctacgaaggccaaggggcataaccaccaactctgccaaagataagtgatgtgaaagcttcatatttgagccaggttgggaaggatgaataagtttaacaggtagaaggacagatatgtgcaaagattcagaagtagtacagggaataggactgggaggagagagcaggaatgggtaaattgggactag

SEQ ID NO: 364263 - DNA, 272 bp, Homo sapiens
catttccacgagtcacggctatggcatacagattcataaagtgggaggacatttttcagttttgttagttgctaactatgtaactatccagctccttaaatgtggctatgttttatgttagagctcagccggtctatcagtgtcgatttagcagaaagcaaacggcttggctgtctcctgctttccagtttccaggtaaggttcttataactaggaaatgtttttgtgtttgttaactgctattgtgactcgtggatatgtccgggatcctc

SEQ ID NO: 364264 - DNA, 347 bp, Homo sapiens
tcctgacctcaagtaattcgccctacttagcctcccaaagtgctgagattataggtgtgagccatcctgcctgttcttattttttgtatttttctagagatgaagtttcaccatgttggccaggttggtcttgaactcctaacctcaggtgatctgcctgcctcagcctcccaaagtgctgggattacaggcatgagccaccgcgccggcctatttttaattttaaaggcggggtctccctatgttactgaggcctttagaactcctgggctcaagcgatcctcctgcctctgcctcccaaagtgctgggattacagccatgagcccccacacccagcggattcagc

SEQ ID NO: 364265 - DNA, 2648 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgaaaaaggaccagtgatgtctaagactcatgatcatcaattggaatcaagtctcagtcctgtggaagtgtttgctaaaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364266 - DNA, 2572 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364267 - DNA, 2739 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364268 - DNA, 2734 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtggagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364269 - DNA, 2418 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364270 - DNA, 933 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccaggaccagctgagggcatagctggccgtccgtttaccctcaggaagcagctag

SEQ ID NO: 364271 - DNA, 1422 bp, Homo sapiens
aatagctgaacaaattggaagagcacagttatgacgcactgacccagggccacgtggcttgtttggaatccagccccgcaggtcccttgctcaagcagctctgcgaagcttctgagcctcgtctcctcatctgcaaaacaggaacgttttcagcacctacctcacagggtcggtaagaggattaaactgtcaactgataatgcacgtactgcctgtgcgggggcctggtaattagtgagcctcctaataggtggtagccgtgttttgtttgttgaaacagtctgtctctgtcgcccaggctggagtgcattgttgcaatctcagctcactgcaacctctgcctctgggtttcaagcgattctcctgcctcagcctcccgagtagctgggaaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364272 - DNA, 443 bp, Homo sapiens
gtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacaggtggggtgctgtgtacacaagacagtgaggttccagctcagataagagacaggttccagctcagataagaggcagtgaggtatggcagaaagtgtgggagaatagacatgacttgctactttataagtactgatgtca

SEQ ID NO: 364273 - DNA, 340 bp, Homo sapiens
taaatagataaaaatgagttgtctttcattttatctatacctaccagaaaaaaaagataaaatctttctacatacttaactccacacttttgggtgggcttgaggaccaacatgtaacagtacctagagctgagactaccttaatatacctttgtcagcatctcactatgaaaacgtatatttcctttattttatgacacgtaaatttgtgctgtctagcatcttctctttctgaagaattgaaacattttgcagacggactggaaactgatggaactctacaaaaatgttttgaagattcaaatgggtaagagcagttccccttctgtcctaaattatg

SEQ ID NO: 364274 - DNA, 2788 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364275 - DNA, 3019 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatggtaagtattgtagtgaaattcagtacctcttaccttgggttcaggcttctgagctatacccaaatctttcctggctcctggtagatttggaatcacatactcattatttgcagagatgctttctttatgtttccacgatctaggggcatacatttactttttccacttttttgcacaaatagttgtggcgggcttgatcttgtattttgacttttttataacaaatactagaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364276 - DNA, 2467 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364277 - DNA, 2066 bp, Homo sapiens
tgtcataatcctatctgttttccagaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcaaaataaaaggggaaaaaaaaaaaaaaaaaaaaaaaaaaaaaaaaaaaaaaaaaaaaaaaaataaaaaaaaaaaaaaataaaaaataaaaaaaaaaaaaaaaataaacttaaacaatacacactatagagaagaatattacaatttgctggccgactttaaacaacaaaaaagaatttttttgcgctggcgtttcccaccttagtttttttgcagtaaaaccttttttcgccggctggcataatagctacatggccccaccccttctcctttagcaacatttccacactctgggggccgattgtaaataccgggccttagtatacatccaaagttcgcgcaaattttttgttaagaagacacttctttctccaccgtcccgaaatatgaaatggcctttttatcatagattcctccaatttggggtctcttgttgctccaatttaaacttgggcccttttttaaaaacaaccccccacattttggtcaaacaccttttttatactatgcccccccggcaacctcccttaacaaaataaccccccagggcttaggtttatttcaccaaa

SEQ ID NO: 364278 - DNA, 709 bp, Homo sapiens
agcggagagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatggtaagtattgtagtgaaattcagtacctcttaccttgggttcaggcttctgagctatacccaaatctttcctggctcctggtagatttggaatcacatactcattatttgcagagatgctttctttatgtttccacgatctaggggcatacatttactttttccacttttttgcacaaatagttgtggcgggcttgatcttgtattttgacttttttataacaaatactagaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagcgatcctcctgcctctgcctcccaaagtgctgggattacagccatgagcccccacacccagcggattcagc

SEQ ID NO: 364279 - DNA, 639 bp, Homo sapiens
gtagaaatcacaagacaactagaattagaattagggccttaaggtgagatgaaattgctgtaaactcatgatgaaacttgaacaaatagggagttgcttcttatggatgagcaaagaaaatattttcttgagatggaatataatccaggtggagatgctatcaacattgttgaaatgacaacaaaggatttagaatattccataaacctagttgataaagcagcagcagggtttgagagggtttactccaattttgaaagaagttctactgttgataaaatgctgtcaaacagcatcacatgctacagggaaatcttttgtgaaaggaacaaacttcattgttttaaaaaattgacacaggcttccaaccttcagcagcccccacactgattagccagcagtcatcaatatagaggcaagactctcaccagcaaaaagattatgacttggtaaggctcagatattcattagcattttttagcactgacgtattttaacttaaggtatgtacacagttttttagacatgctattaattactaattaataattattaaatactcattagactacaatatagtttaagcataacttttataagcactgggaaataaaatgtttatgcaactaaaaaaagtaa

SEQ ID NO: 364280 - DNA, 376 bp, Homo sapiens
tgtttccagagtgtgatctcctacaggagattatgttgggttggcccagaggagaagggagggagtgtttttgggtggggcgacagagacatgagagatatctgtacagctgcaggtttagggaagattggaactgctccctcctccctgcctctcacataggaaagctgggctagaaattctgaggttcccagcattggccaatgaagtcccaaagccctgcctagcctagaggcagcacagggtcatgtagaatgaccatagagagaaagacacacatgaactgataaatattttagcaattaaagacctccatattctttactcaactctagacaaagggaaggaaatccaagactgaggttggagcttaaac

SEQ ID NO: 364281 - DNA, 818 bp, Homo sapiens
ttcaccaagatgctaaaggaatccaagcacaaaaggaagttaaaaagcacctgcctgacccagtgcagtggctcacagctgtaatcccagcactttgcgaggccgagacaggcgaattgcttgagccctggagttagagaccagcttggacaacatggtgaaattccgtctctataaaaaatgcaaaaattagcagggtgtgatggtacatgcctgtagtaccagtgctggggaggctgagtaactgggaccacaagtacacggcaccacgtctgggtaatttgtttcttttctttttattttcgtagcgatagggtcttgccacattgcccaagctggcctcgaactctggtgctcaagcaattcacccaccgtggtctcccaaattgctgaaattataatcgtgagccatcatgcctgaccgtaaaagttttattataagaatccaaggccttcaccaagatgctaaaggaatccaagcacaaaaggaagttaaaaagcacctgcctgacccagtgcagtggctcacagctgtaatcccagcactttgcgaggccgagacaggcgaattgcttgagccctggagttagagaccagcttggacaacatggtgaaattccgtctctataaaaaatgcaaaaattagcagggtgtgatggtacatgcctgtagtaccagtgctggggaggctgaggtgggaggattacctgagcctgagaaatcaaggctgtagtgagccgtgatcatgctactgcactctagcctgggagaaagtgagaccctgtctctcaaaaaaagcgcttgctctaatcagacat

SEQ ID NO: 364282 - DNA, 3776 bp, Homo sapiens
gcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtgtaagggagtgggagctggtccgtgccgcggcggccgcgcagggagctctcgaggcaacgccggggcgcccgaggtctggaaggcgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364283 - DNA, 3581 bp, Homo sapiens
accttccgtctgtgcatgttttcttcaatcctggaaggaaatcataagtgatttgccccaaaaggattgctgttgaaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364284 - DNA, 3672 bp, Homo sapiens
gctttctttatgacagacctaatagtaggcttaaaggatagtataatagtgaacaaaacagagataagcgaggcacttgtcctcttaaaatatattcaggtaggagatacgaatcataagtaaacaatagctaagcaagataattaaatatgtctccaattttgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364285 - DNA, 3893 bp, Homo sapiens
tgaggggataatcagcctttattgtctctcgtgcactgtgcccagcgctccctctagcggctacaagcgctcactgcccacactctctactaggctctccggaggcctcggtttcgctggagagaaagagattgcgcaggcgcggagcagccgacgtggccgcaggggaccgtgcctggggggggtctgcgcggggccgctgactcgcgaggttctctgtcgcctgccgccctcgctccttttctccccttctagagtgttacggtgactcttgggtccgaaggggacggacgtcctcccacgtaccatttagaagagtcatcttagtgggatttggggaagcaacagggctgtgtggggtaacctgccacctttaagtggaaatcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364286 - DNA, 3054 bp, Homo sapiens
gcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtgtaagggagtgggagctggtccgtgccgcggcggccgcgcagggagctctcgaggcaacgccggggcgcccgaggtctggaaggcgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattgttcccgatagaggggaacaatcacttcgttggaaagtgccgagattcccccattc

SEQ ID NO: 364287 - DNA, 2127 bp, Homo sapiens
atagtaaaacaatttagatgttcatttaagaatgttgcaagatgagtggtaaaaatcaagggaataatatatttttcctaagttttctttttttatggtcatattagttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364288 - DNA, 1793 bp, Homo sapiens
cggacgcgtgggtcgacccacgcatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364289 - DNA, 1466 bp, Homo sapiens
  misc_feature (14)..(14): n is a, c, g, or t
  misc_feature (43)..(43): n is a, c, g, or t
ggatcaatccaaancttatgaatgatgaaggtaatagcaatgngaatcctcccagattaccagataaaggattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364290 - DNA, 1966 bp, Homo sapiens
  misc_feature (1950)..(1950): n is a, c, g, or t
gcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtgtaagggagtgggagctggtccgtgccgcggcggccgcgcagggagctctcgaggcaacgccggggcgcccgaggtctggaaggcgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatgggttggtaaccaaccgaattaatgggttcaaagggatttttcaaactgggcttggccaangggaattgggaaatgt

SEQ ID NO: 364291 - DNA, 144 bp, Homo sapiens
ggcgcccgaggtctggaaggcgcaggcaggtggggcgcgggggagttcacccctgcgcggtcccttgggtgggcggggtgggcgccccaggccccgcggactcggctgggaggctgagcgggcgacggtcacgggacaagggtg

SEQ ID NO: 364292 - DNA, 346 bp, Homo sapiens
tgaggggataatcagcctttattgtctctcgtgcactgtgcccagcgctccctctagcggctacaagcgctcactgcccacactctctactaggctctccggaggcctcggtttcgctggagagaaagagattgcgcaggcgcggagcagccgacgtggccgcaggggaccgtgcctggggggggtctgcgcggggccgctgactcgcgaggttctctgtcgcctgccgccctcgctccttttctccccttctagagtgttacggtgactcttgggtccgaaggggacggacgtcctcccacgtaccatttagaaggtcagagtgggcagaacctagtctgagcag

SEQ ID NO: 364293 - DNA, 3821 bp, Homo sapiens
tgaggggataatcagcctttattgtctctcgtgcactgtgcccagcgctccctctagcggctacaagcgctcactgcccacactctctactaggctctccggaggcctcggtttcgctggagagaaagagattgcgcaggcgcggagcagccgacgtggccgcaggggaccgtgcctggggggggtctgcgcggggccgctgactcgcgaggttctctgtcgcctgccgccctcgctccttttctccccttctagagtgttacggtgactcttgggtccgaaggggacggacgtcctcccacgtaccatttagaagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364294 - DNA, 3759 bp, Homo sapiens
gcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtagtcatcttagtgggatttggggaagcaacagggctgtgtggggtaacctgccacctttaagtggaaatcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364295 - DNA, 3373 bp, Homo sapiens
gcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtgtaagggagtgggagctggtccgtgccgcggcggccgcgcagggagctctcgaggcaacgccggggcgcccgaggtctggaaggcgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttctaacaaaaacaacacaaaagcacaacaaaaaacagtgtgttgggacggactatggaccccgtcgaaaaaaacctttttaaaaaccaaatgcgtatgggaccaggggagcccaagagcgtctagtcgaactggggacacaaagggtccccgaaggagaacaccccgagcccaagcaaccacaaggtccgagagagctccacaacgcgaattaaaaaaaggccccgcgggagaaacaagaagacgtctcggaaaacaatcccccagacgggagatctcgagggcaaaacgggggaatctcacacaccagcggtctacacagggaagctcggacaaaaaaataac

SEQ ID NO: 364296 - DNA, 2350 bp, Homo sapiens
ttaaattttcttttaaaaaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggtgagacctgcggaccagcaacatcacatcgtcctatctggaatccttagaaatgcagaattttagggacagacacacctactgattcagaatctgcattttcacaagatccctagttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgag

SEQ ID NO: 364297 - DNA, 2228 bp, Homo sapiens
  misc_feature (1773)..(1773): n is a, c, g, or t
gcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtgtaagggagtgggagctggtccgtgccgcggcggccgcgcagggagctctcgaggcaacgccggggcgcccgaggtctggaaggcgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtattacagtaatgttaatttttttccctgtatgacattaagcctttggaaccaaataaagatattgtttattagggaatactgagaaagataatattttgtattttggttttaaatgatcaatttagaaataaatgtagaaggaactagtcttttgaaacatcagatattgtcatataagtataaattcttcctggcctattattctgttntactattgggaaaatggatagtgaaaagcttcaggaatcttcaaattcttaatagttctgaatctaaaattagttatgttcgtttcccctttgaagctccctcttaacctccccctacccctgtccctcagctgtggtctgaatgtgtcccttcaaaattcatatattgaaatcctaacccctgaggtgatggttttaggaggtggggcctttggaaggtgattaggtcatgagggaggagccctcatcaatgggattagtcccttataaaagagatcccaaagagctgccttgtccctttcactatgtgaggaagcagtaagaaggtgtcattctatgaaccaggaagtgggcccctcaccagagaccaaatgtaccagcaccttagtcttgtacttcccagcctctagaattgtgagaaataaatttttgttgttaataagctactagtttat

SEQ ID NO: 364298 - DNA, 500 bp, Homo sapiens
cacagccatgagcctcggcgtttattccttcctctctggagtgccttcccctactacagagatttgaaagcttgaactacatttcccacagccctttgcagtcagggtcctggttacaaaatcagttctgtaagagaagcacttacatgacgttagaagacagaaggcaaacaggaaagaccagtgtccagcctcctgctccagtcgcagcagtggctggattcagcatccccatggccagccatcagctttctgtgtcaaaaggcagctgtctctacgactgaggatttaggcccacgggcactggcagctccctaatcccatcttcccgattccctgggtcacagctatgacaacgtgttcctggagttaatttcctgttccttggtattctggtagtcattcctggagacccagactggaattgagccatcagcctcttcagatgattttgtaaatctttaagtgcctgtattaaatcccttcctgcttaaagtacc

SEQ ID NO: 364299 - DNA, 2400 bp, Homo sapiens
  misc_feature (1644)..(1644): n is a, c, g, or t
tcctttgtcaaagatcagttgaccatatttatatggatctatttctgggctctctgttctgttgcattgctctctatctgttgtccttcctttcactgctaccatactgtctttgattcctatagctttacagttagtcttgaagtcacaaaagcatgggatcccccattagtggatcgtcctggaatttttaactctcagatttgtacacacctagccttcagcaatttgtgaattacagttcagattttcctaccctagcactggttcccaaagaggtttctgttaaagtatgttgtgattctctccatctacgactttctcttcctatttttgggacagaggtttgtcttgtgacctcacttctcttacagatctaagagtaatggttgatttttcagtttgttcaactttttacttgttaggatagagtggtgacttccaagcttcatgcagaaccggacaacagaaattgagagggaaatttctatgacagaagagagaaagaagaaaattgctggaataatgaccttgaatagaggaaatgggatatcatctggtaagcaaatagagaagctggctttagataagagcctggacaattcattcatagaatagcagaaaaggcagaatttatgtccatagatgcaagtggtatagtagatatagtgatgggagtttgtaaaagttaccttctaattgctattttttttaatgaaataagaaacaaagtcatcaactcaaagtgagtaatatgtaggaggtgattattgtttgaggagagaggagaatgtgtgatatcttttgttaattatggtaaaatataacacaaaatttgccattttaaccattttaagtggacaattaagtgtcattaattacattcacactgttgtacatctgccaccactatcttcttctaaaactttttatcacctcttatagtttaaattgtgcccccacagaagatatgttggagtcctatcccttaatattaatgtgaccttatttggagataggatctttataaaggtattcaaattaacatgagatcattagggtggaatcctaatccaatatgattagtgtccttataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttagaatacatcattctaaatagaaattttttaataattaagtattttcctctccttggagcacttggtaacttctaattctactttctatctctattaatttgcctattctagatatatcaaatgagtgaaataatacaatagttgtctttttgtgtctggcttcttttactttgcataatgttttcaaggttcattcatgttgtagcatgtatctgaacttcattctttttctggctgaaaattttattatatgtatgtatnacattttgtgtctctattcatcacttgatggatatttggatagatttaagtcatttgtcttttgtgaatagtgctattaatattatgaacacttgagtacaagtttttgtttaaatacctcttttcttttttcttggatgtattatctaggtgaagaatggcaagatcatatggtaattctatttagctttttgaggaactgccaaacctttccacaatgactgcacaattatacatttccagtagggttccagtttatccatattctcaccaatgcttttatttttctgttttttaaaattatactgatcataggaggtgtaaagcagtatttcagtttggttttgatttgcatttccctaatgattaatgatgttgagaatcctttcacatgcttattgaccatttttatgtcattttgggaaaatatttattcacatttttgcccattttttagttgggttgtctttttttgctgttgagttgtaggagttctttatattttctggatattaaaccctcatcagataaattatttgcaaatgttttcttccattctgttaattttcttaatgttgtcttttgatgcacattgtaaaaatttttaaaatcaatttccattttcttatttttttattattatgctttaagttctgggatacatgtgcagagcgtgcaggtttgttacataggtatatacgtgccatggtggtttgctgcacccatcaacccatcatctacattaggcgtttctcc

SEQ ID NO: 364300 - DNA, 931 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaagcagtgagaaggtgcgcatcgcttgggggtggatgtgggtatcagaggtgaacactggatacgcgacctggtcatgggaggcgggcggtgagaaggagagagagatgggtaattggaatggcacacaacaattaaaaaaaaatgatctaccttttgctagcttgatttccatacactcggttcacctcagaccatgcttgggaagaaaaaggttgcagcttctagcagggaaaaggcagactagatgaggaagagagggctacttccacaggcgaggacagttgtctggggagccctgagaggg

SEQ ID NO: 364301 - DNA, 2903 bp, Homo sapiens
gtctctgtttttgtgaatccctgtaggtagatctgtccccaggtctgtggaactgtcagttgtgaagttttgtaaaatggtcacccaacttaaaactaggaaattacgaagaagagaaaattgccctgtatctgttaaggttggtgtaaaggtacagggacaggggggcaacttcgactagagaattccatctcttctgttttgtcattttaccaattattcccatctgccccaccccctgctgctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaattgtc

SEQ ID NO: 364302 - DNA, 3606 bp, Homo sapiens
agcgggttttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364303 - DNA, 4287 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364304 - DNA, 4400 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364305 - DNA, 4056 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaagaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364306 - DNA, 4186 bp, Homo sapiens
ctggaaacccatgttgcatttcagttcaggaaagaatgcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364307 - DNA, 2961 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaattgtc

SEQ ID NO: 364308 - DNA, 3074 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaattgtc

SEQ ID NO: 364309 - DNA, 2995 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaaggtaaggaggagaaagttactccagatcagtgcaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaattgtc

SEQ ID NO: 364310 - DNA, 1277 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggatagagtggtgacttccaagcttcatgcagaaccggacaacagaaattgagagggaaatttctatgacagaagagagaaagaagaaaattgctggaataatgaccttgaatagaggaaatgggatatcatctggttctggagacagcctgtatttcttggatcttggcttccttccatcttcaaagccaacgatgaccagtgtagactttctatgctgcttcaatctgacatggagtccctgccttccacatctaaagtacccttgcaattacattggccaagataacccagaataatcttaaattaaactcagctgaatagcaatcttaaa

SEQ ID NO: 364311 - DNA, 2786 bp, Homo sapiens
  misc_feature (2030)..(2030): n is a, c, g, or t
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggatagagtggtgacttccaagcttcatgcagaaccggacaacagaaattgagagggaaatttctatgacagaagagagaaagaagaaaattgctggaataatgaccttgaatagaggaaatgggatatcatctggtaagcaaatagagaagctggctttagataagagcctggacaattcattcatagaatagcagaaaaggcagaatttatgtccatagatgcaagtggtatagtagatatagtgatgggagtttgtaaaagttaccttctaattgctattttttttaatgaaataagaaacaaagtcatcaactcaaagtgagtaatatgtaggaggtgattattgtttgaggagagaggagaatgtgtgatatcttttgttaattatggtaaaatataacacaaaatttgccattttaaccattttaagtggacaattaagtgtcattaattacattcacactgttgtacatctgccaccactatcttcttctaaaactttttatcacctcttatagtttaaattgtgcccccacagaagatatgttggagtcctatcccttaatattaatgtgaccttatttggagataggatctttataaaggtattcaaattaacatgagatcattagggtggaatcctaatccaatatgattagtgtccttataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttagaatacatcattctaaatagaaattttttaataattaagtattttcctctccttggagcacttggtaacttctaattctactttctatctctattaatttgcctattctagatatatcaaatgagtgaaataatacaatagttgtctttttgtgtctggcttcttttactttgcataatgttttcaaggttcattcatgttgtagcatgtatctgaacttcattctttttctggctgaaaattttattatatgtatgtatnacattttgtgtctctattcatcacttgatggatatttggatagatttaagtcatttgtcttttgtgaatagtgctattaatattatgaacacttgagtacaagtttttgtttaaatacctcttttcttttttcttggatgtattatctaggtgaagaatggcaagatcatatggtaattctatttagctttttgaggaactgccaaacctttccacaatgactgcacaattatacatttccagtagggttccagtttatccatattctcaccaatgcttttatttttctgttttttaaaattatactgatcataggaggtgtaaagcagtatttcagtttggttttgatttgcatttccctaatgattaatgatgttgagaatcctttcacatgcttattgaccatttttatgtcattttgggaaaatatttattcacatttttgcccattttttagttgggttgtctttttttgctgttgagttgtaggagttctttatattttctggatattaaaccctcatcagataaattatttgcaaatgttttcttccattctgttaattttcttaatgttgtcttttgatgcacattgtaaaaatttttaaaatcaatttccattttcttatttttttattattatgctttaagttctgggatacatgtgcagagcgtgcaggtttgttacataggtatatacgtgccatggtggtttgctgcacccatcaacccatcatctacattaggcgtttctcc

SEQ ID NO: 364312 - DNA, 2825 bp, Homo sapiens
  misc_feature (2069)..(2069): n is a, c, g, or t
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaagaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaaggcaatgaatgacacttcctgttgcctcatatcctcaccagtatttggcactgatagagtggtgacttccaagcttcatgcagaaccggacaacagaaattgagagggaaatttctatgacagaagagagaaagaagaaaattgctggaataatgaccttgaatagaggaaatgggatatcatctggtaagcaaatagagaagctggctttagataagagcctggacaattcattcatagaatagcagaaaaggcagaatttatgtccatagatgcaagtggtatagtagatatagtgatgggagtttgtaaaagttaccttctaattgctattttttttaatgaaataagaaacaaagtcatcaactcaaagtgagtaatatgtaggaggtgattattgtttgaggagagaggagaatgtgtgatatcttttgttaattatggtaaaatataacacaaaatttgccattttaaccattttaagtggacaattaagtgtcattaattacattcacactgttgtacatctgccaccactatcttcttctaaaactttttatcacctcttatagtttaaattgtgcccccacagaagatatgttggagtcctatcccttaatattaatgtgaccttatttggagataggatctttataaaggtattcaaattaacatgagatcattagggtggaatcctaatccaatatgattagtgtccttataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttagaatacatcattctaaatagaaattttttaataattaagtattttcctctccttggagcacttggtaacttctaattctactttctatctctattaatttgcctattctagatatatcaaatgagtgaaataatacaatagttgtctttttgtgtctggcttcttttactttgcataatgttttcaaggttcattcatgttgtagcatgtatctgaacttcattctttttctggctgaaaattttattatatgtatgtatnacattttgtgtctctattcatcacttgatggatatttggatagatttaagtcatttgtcttttgtgaatagtgctattaatattatgaacacttgagtacaagtttttgtttaaatacctcttttcttttttcttggatgtattatctaggtgaagaatggcaagatcatatggtaattctatttagctttttgaggaactgccaaacctttccacaatgactgcacaattatacatttccagtagggttccagtttatccatattctcaccaatgcttttatttttctgttttttaaaattatactgatcataggaggtgtaaagcagtatttcagtttggttttgatttgcatttccctaatgattaatgatgttgagaatcctttcacatgcttattgaccatttttatgtcattttgggaaaatatttattcacatttttgcccattttttagttgggttgtctttttttgctgttgagttgtaggagttctttatattttctggatattaaaccctcatcagataaattatttgcaaatgttttcttccattctgttaattttcttaatgttgtcttttgatgcacattgtaaaaatttttaaaatcaatttccattttcttatttttttattattatgctttaagttctgggatacatgtgcagagcgtgcaggtttgttacataggtatatacgtgccatggtggtttgctgcacccatcaacccatcatctacattaggcgtttctcc

SEQ ID NO: 364313 - DNA, 1158 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaagaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggttctggagacagcctgtatttcttggatcttggcttccttccatcttcaaagccaacgatgaccagtgtagactttctatgctgcttcaatctgacatggagtccctgccttccacatctaaagtacccttgcaattacattggccaagataacccagaataatcttaaattaaactcagctgaatagcaatcttaaa

SEQ ID NO: 364314 - DNA, 619 bp, Homo sapiens
ttcccgacaccctcgcggcgagcgggttttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcaagtgcgggtgcatgaggtgggggtccgggttgcgggggtggtctggcagggtggaccagcaggcagcctgccccgcggaccctgacagcctggcaacgaggagacgatccggtcggagccaggcgcttgagagaggtgcgcagtgcccgagacccctggcgatggggaggcggtgaccggagcgggcctggccaagggctgaggggctggctcgggaggcaccgccagatcgtttggaggagaaccgcgctgaccgcttcccagccagctttgcaggcgcccgcgccccgccctcgacggtgtctgtgcccggagagggctgtgggggaggctcctgcgggagaaatggcggagcgggagccgctgtgggggcgcccgggaaggccgttggggggcgcccggcgaggccggcgggggtcgg

SEQ ID NO: 364315 - DNA, 758 bp, Homo sapiens
  misc_feature (9)..(9): n is a, c, g, or t
  misc_feature (142)..(142): n is a, c, g, or t
  misc_feature (148)..(148): n is a, c, g, or t
tgacttcgnccgttactcttgcgccgctttgcgctgccgcgttgttcccgccgggccgtgtgccccggccgttttctgttttccccgtgttttgcgtgtttgtgctccccctgccgcgcgccctcgcccgcgccttgctgcngttgcncccgtcgctgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaattgtc

SEQ ID NO: 364316 - DNA, 3505 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtagatctgtccccaggtctgtggaactgtcagttgtgaagttttgtaaaatggtcacccaacttaaaactaggaaattacgaagaagagaaaattgccctgtatctgttaaggttggtgtaaaggtacagggacaggggggcaacttcgactagagaattccatctcttctgttttgtcattttaccaattattcccatctgccccaccccctgctgctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaattgtc

SEQ ID NO: 364317 - DNA, 4189 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaagaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364318 - DNA, 3645 bp, Homo sapiens
agcgggttttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggctccaggttgatgtcaaagtcttgtgtctgtgcggtaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364319 - DNA, 4158 bp, Homo sapiens
  misc_feature (17)..(17): n is a, c, g, or t
agtgaggaagagtcttncctggagggaacatggccctgccaacaccttggttcaggacttctggcctccaatactgagagaatacatttctgttattgtaacccacccagtttctggttgctccatgcatccctcaactacagacaaacagagagccaaatcatgaatgaactcccattcacaattgctgcaaagagaataaaatacctaggaataaagctaacaaggaaagtgaaggacctcttcaaggagaactacaaaccactgctcaagggaataagagaggacacaaacaaatggaaaaacagtccatcctcggggataggaagaatcaatatcatgaaaatggccacactacccaaagtaatttataaattcagtgctattcccatcaaactaccattgacattcttcacagaattagaaaaaaactagttttaatttcatatggaacaaaaaaagagccctatagcgaagacaatcctaagcaaaaagaaaaaaagttggaagagactcaaagccccatttccttcctccacccctaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364320 - DNA, 2860 bp, Homo sapiens
ctggaaacccatgttgcatttcagttcaggaaagaatgcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaattgtc

SEQ ID NO: 364321 - DNA, 3220 bp, Homo sapiens
agcgggttttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 364322 - DNA, 2821 bp, Homo sapiens
  misc_feature (2065)..(2065): n is a, c, g, or t
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaagaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggatagagtggtgacttccaagcttcatgcagaaccggacaacagaaattgagagggaaatttctatgacagaagagagaaagaagaaaattgctggaataatgaccttgaatagaggaaatgggatatcatctggtaagcaaatagagaagctggctttagataagagcctggacaattcattcatagaatagcagaaaaggcagaatttatgtccatagatgcaagtggtatagtagatatagtgatgggagtttgtaaaagttaccttctaattgctattttttttaatgaaataagaaacaaagtcatcaactcaaagtgagtaatatgtaggaggtgattattgtttgaggagagaggagaatgtgtgatatcttttgttaattatggtaaaatataacacaaaatttgccattttaaccattttaagtggacaattaagtgtcattaattacattcacactgttgtacatctgccaccactatcttcttctaaaactttttatcacctcttatagtttaaattgtgcccccacagaagatatgttggagtcctatcccttaatattaatgtgaccttatttggagataggatctttataaaggtattcaaattaacatgagatcattagggtggaatcctaatccaatatgattagtgtccttataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttagaatacatcattctaaatagaaattttttaataattaagtattttcctctccttggagcacttggtaacttctaattctactttctatctctattaatttgcctattctagatatatcaaatgagtgaaataatacaatagttgtctttttgtgtctggcttcttttactttgcataatgttttcaaggttcattcatgttgtagcatgtatctgaacttcattctttttctggctgaaaattttattatatgtatgtatnacattttgtgtctctattcatcacttgatggatatttggatagatttaagtcatttgtcttttgtgaatagtgctattaatattatgaacacttgagtacaagtttttgtttaaatacctcttttcttttttcttggatgtattatctaggtgaagaatggcaagatcatatggtaattctatttagctttttgaggaactgccaaacctttccacaatgactgcacaattatacatttccagtagggttccagtttatccatattctcaccaatgcttttatttttctgttttttaaaattatactgatcataggaggtgtaaagcagtatttcagtttggttttgatttgcatttccctaatgattaatgatgttgagaatcctttcacatgcttattgaccatttttatgtcattttgggaaaatatttattcacatttttgcccattttttagttgggttgtctttttttgctgttgagttgtaggagttctttatattttctggatattaaaccctcatcagataaattatttgcaaatgttttcttccattctgttaattttcttaatgttgtcttttgatgcacattgtaaaaatttttaaaatcaatttccattttcttatttttttattattatgctttaagttctgggatacatgtgcagagcgtgcaggtttgttacataggtatatacgtgccatggtggtttgctgcacccatcaacccatcatctacattaggcgtttctcc

SEQ ID NO: 364323 - DNA, 1143 bp, Homo sapiens
ctggaaacccatgttgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggttctggagacagcctgtatttcttggatcttggcttccttccatcttcaaagccaacgatgaccagtgtagactttctatgctgcttcaatctgacatggagtccctgccttccacatctaaagtacccttgcaattacattggccaagataacccagaataatcttaaattaaactcagctgaatagcaatcttaaa

SEQ ID NO: 364324 - DNA, 2027 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364325 - DNA, 1897 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364326 - DNA, 2203 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaaaaaaaaaaaaaaaaaaaaaaaaaaagggggggagcgaacaaaaagatttcccctgggaggggccaaaagttaaggggtaaccagagttttttggtcaaaggggggccccatatagggagggcgtattaaaagcaagaggaaagggcggagttttaaaaaggttgtggacggggaa

SEQ ID NO: 364327 - DNA, 2168 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaaaaaaaaaaaaaaaaaaaaaaaaaaccccggaggcactccaatgcggggcggcggcaaaagcagggcacgcgatagggcccgggcccaagcggttcccggacccagttttttggtcccgggggtaaacggcgggcccccaa

SEQ ID NO: 364328 - DNA, 2389 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaaaaaaaaaaaacaataacaaatacaaggaaaaaaacacaaacaacagaaccaaagaacaccaaaaaacccaaaccaaaccaaaacaaaaaaggaaggggggcccgccccaaaaacataggtacccgcagagaggaggggcaccgaagttagtgaccacacccggagttttgtggatacaaacggagagggccacccacgaagaagagagagcgaacataattaaacagcgcaaggcagaggcagcacgagcagttatcaaccacgcacgttggcacgggcgacacacaccgggcccggagcaacactggtagagcagacaccaactgcgggggggaccaacaggggcacaaacacccgcggt

SEQ ID NO: 364329 - DNA, 1829 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacggttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364330 - DNA, 1752 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacggggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364331 - DNA, 1642 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagagggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364332 - DNA, 2071 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggatagac

SEQ ID NO: 364333 - DNA, 1771 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364334 - DNA, 1520 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagagacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364335 - DNA, 1337 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364336 - DNA, 767 bp, Homo sapiens
tgcttgtccttactagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364337 - DNA, 869 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccagtattagaggcaccgcctgcccagtgacacatgttttacgggcgcggtcccctacccgtgcaaagtagcataatcacttgttcct

SEQ ID NO: 364338 - DNA, 290 bp, Homo sapiens
  misc_feature (12)..(12): n is a, c, g, or t
  misc_feature (14)..(14): n is a, c, g, or t
  misc_feature (33)..(33): n is a, c, g, or t
  misc_feature (40)..(40): n is a, c, g, or t
  misc_feature (80)..(80): n is a, c, g, or t
taggcctagggngnaaagacggtaatttattanaatttcnccttttttagtacatgcacagaaagcctgacagccaagtntacacgaacatacacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364339 - DNA, 1001 bp, Homo sapiens
gctcgacactggtcatccttttcccagggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggatagac

SEQ ID NO: 364340 - DNA, 694 bp, Homo sapiens
tgcttgtccttactagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364341 - DNA, 2153 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364342 - DNA, 2527 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaaaaaaaaaaaaaaaaaaaaaaaaaaaaaaaaaaaaaaaaagggggggccaaacaaaaaaataccccaaaaaggggcacacaaatataagagaaaaaccagaaaataattgaaaaagaagggggcaccacaaaagaaaagacgaaaataaaacaaaagaaaacagaagacagagaaatataaaacagatcagaaaacgagaaaacaaaggaaacgaaggaaaacactgagaaaacaaaaaaccaaccaacatccgcggggaggaaacacacaaaaacaaagtcggtaccaacaaatcaaccatcaaaagaagaagaattataaagacccatacctagaaagaggaaaaaattaatacagaaaattattaaaaagaagctaaaaaggcgagcggtaacaaaactaagaagctaaaatataagtaacatgacaataatataaaaaaaatatagagtcaacacatcagcaaaaatcatcaatatacaaaaaaaatattataaca

SEQ ID NO: 364343 - DNA, 2103 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364344 - DNA, 2168 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364345 - DNA, 2603 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaaaaaaaaaaaaaaaaaaaaaaaaaaaaaaaaaaaaaaaaagggggggccaaacaaaaaaataccccaaaaaggggcacacaaatataagagaaaaaccagaaaataattgaaaaagaagggggcaccacaaaagaaaagacgaaaataaaacaaaagaaaacagaagacagagaaatataaaacagatcagaaaacgagaaaacaaaggaaacgaaggaaaacactgagaaaacaaaaaaccaaccaacatccgcggggaggaaacacacaaaaacaaagtcggtaccaacaaatcaaccatcaaaagaagaagaattataaagacccatacctagaaagaggaaaaaattaatacagaaaattattaaaaagaagctaaaaaggcgagcggtaacaaaactaagaagctaaaatataagtaacatgacaataatataaaaaaaatatagagtcaacacatcagcaaaaatcatcaatatacaaaaaaaatattataaca

SEQ ID NO: 364346 - DNA, 1954 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364347 - DNA, 1882 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacggggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364348 - DNA, 2010 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364349 - DNA, 1705 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgccccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364350 - DNA, 1668 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364351 - DNA, 1459 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgattcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364352 - DNA, 1743 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcacatgttgcccaggctggtctcgaactcctggactcaaaggatccacctgcctcagcctctcaaagtgctgggatta

SEQ ID NO: 364353 - DNA, 1901 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364354 - DNA, 1404 bp, Homo sapiens
  misc_feature (1402)..(1402): n is a, c, g, or t
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacgactacagcgtgctatacgggaccgagctnga

SEQ ID NO: 364355 - DNA, 816 bp, Homo sapiens
gctcgacactggtcatccttttcccagggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364356 - DNA, 1232 bp, Homo sapiens
cagctctcaggtccgacacccgctggaagccggcgcgggcgcaggcgcgcagcgaaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaatcccaagcttctcccttacccacacctatccttttgaggggctttggggtggggctggggcaagcagagggactgggtcttcacttcttgggctaataaaattgtttctttgtggactaa

SEQ ID NO: 364357 - DNA, 660 bp, Homo sapiens
ggacgcgtgggtcgacccacgcgtccgcggacgcgtgggctgaaacagattcctacacatgactatcagaagagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaa

SEQ ID NO: 364358 - DNA, 414 bp, Homo sapiens
cagccaaaatgtttaaaaacactcagtttctggtcccaaagaatggtttctcagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364359 - DNA, 3685 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364360 - DNA, 3618 bp, Homo sapiens
tgcgcgaggattgggcgagagggtggggccactcaacgctgaggcggcgaatggccggagcagacttaaatcaagaggctggggacctctaagatcaaagtttggggcggggcctaaggagggggcggggcctccagattcgagacctggaagggctggggcggcgcttggggcggcccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364361 - DNA, 3454 bp, Homo sapiens
  misc_feature (17)..(17): n is a, c, g, or t
gagatatttccttggtnctgtgtgcctgggattgttgaatttcgtcacggatggggtagctcgatcacgcaccgatacgtctcgtccctgtgcccatgcctgaattcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364362 - DNA, 3497 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccaggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364363 - DNA, 3255 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccaggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364364 - DNA, 3443 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364365 - DNA, 3459 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgctcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364366 - DNA, 4061 bp, Homo sapiens
  misc_feature (4060)..(4061): n is a, c, g, or t
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaatggtggtagcccctggctggcctttatgaagctgtgttgatctgcagaattcctgtcccttctcaagttctcagcatgagcacatgggaacccaggtccttgtcttgccatacccagtttagctgggactggaatcctgttttctgttttctagggccatatccatcccgttcaggcctggatgcttgtgcctgtcctggacaggcagtactagaggtagaagggcctcggggctcagctcaagtgaactgcaacaaatgcaactacaggagacacaacagaatgagggagatgttgaagcaggagagacgaaagtgggtgggatggtgagtgctgggtggagctggctgctcagcatgcagagttggggttgagnn

SEQ ID NO: 364367 - DNA, 3734 bp, Homo sapiens
  misc_feature (3686)..(3686): n is a, c, g, or t
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaatnaaaaacacacaaaacaaacgaaagcaaatagaaagaacaaaaaaaagg

SEQ ID NO: 364368 - DNA, 3565 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364369 - DNA, 1934 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaactgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364370 - DNA, 673 bp, Homo sapiens
  misc_feature (672)..(673): n is a, c, g, or t
caattccctctgggaccagagactgagtctttctaaacattttggctggactgaggtgctgttaccaccctccatgaaggccactacctagtgacagccctaacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaatggtggtagcccctggctggcctttatgaagctgtgttgatctgcagaattcctgtcccttctcaagttctcagcatgagcacatgggaacccaggtccttgtcttgccatacccagtttagctgggactggaatcctgttttctgttttctagggccatatccatcccgttcaggcctggatgcttgtgcctgtcctggacaggcagtactagaggtagaagggcctcggggctcagctcaagtgaactgcaacaaatgcaactacaggagacacaacagaatgagggagatgttgaagcaggagagacgaaagtgggtgggatggtgagtgctgggtggagctggctgctcagcatgcagagttggggttgagnn

SEQ ID NO: 364371 - DNA, 452 bp, Homo sapiens
catgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgaccgtgagtgctgggtggggtgggtgaggcagagtggtccacattcactgttctgtatgcccagtgcccacagttcccacccattcaatctagtgtggccagggcctccctccctaccttttccccaaagcccctgctcctcctgggctcttgtcactgtggccacccctcaggccatgcaggcaaacctgccgcaaactgtgccagcctcctctacaccctggccacccctccctctcacaccacaggccccacg

SEQ ID NO: 364372 - DNA, 3556 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaat

SEQ ID NO: 364373 - DNA, 4029 bp, Homo sapiens
accagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaaccccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccaccagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaataaaaaaaaaaaaaaaaaaaaaaaaaaaagggggggggggtaaaaatatccccgggggggccaaaattagggggtcccgagttttttggaaaacaggggggcccacaagagggggacgcgataaaaaacaccagggcaggggaccgcagtaaaacaacggccgaacgagggaaacaccgcgcagacggggaccctgtgggaggggacccaaacgcgggggggcacacagggacaacatacctgaggaaattacgcatcagggacaagttaacctcgcgggggactaggggacaccaacggctaagcgggcggaggaaattggcacggggtcgtctagaaattacg

SEQ ID NO: 364374 - DNA, 603 bp, Homo sapiens
  misc_feature (17)..(17): n is a, c, g, or t
gagatatttccttggtnctgtgtgcctgggattgttgaatttcgtcacggatggggtagctcgatcacgcaccgatacgtctcgtccctgtgcccatgcctgaattcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccaggtgagcgaccagccaccaggccttcccatgtggggccacacagaggtataaggccacctggttccagtagttggaagagggaacagtcaagggctagacacccaggtagatacccaggtgtgcagagaccagggagcagcagcagag

SEQ ID NO: 364375 - DNA, 325 bp, Homo sapiens
agatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggattcgctaaatattgtaatggatcaaggagatacacctacactagaggaagatttgaagaaacttcagctctctgaattctttgatatctttgagaaggagaaagtagataagga

SEQ ID NO: 364376 - DNA, 4553 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccataaaaaaaaat

SEQ ID NO: 364377 - DNA, 4401 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccataaaaaaaaat

SEQ ID NO: 364378 - DNA, 4481 bp, Homo sapiens
ttgtctgtatttatttttgcttattgttgtttttttatctctccttatttataatttccgttgttttatctttttttcggcatttcaatttttttttctcactcttgtctacgcctctataagtgcttttttccctgtcttcgacgtgggtgcgtggttgtgtttccccactggttgtattgtctgtctacgctcgtcgcactaccgtaggggtatagaaagctaggtttgtttacgtcctgctgttctacatggcatgtcgccgcaacggttgcctcaacgctggttttttttggcttcagttgtctgcaccggtgctgtttgttgactggacatgtttgtcctttcttagattctaattagctcgtgttgatattttccgttggtgcttcctattttgtgttgttctcccttgtgtctattcttcttattttcttctggtgtagtttcttctttatttttttttttctctcttttttgtttttttttttttttttttccttttttttttttttttttttttttttttttttttttaatttggaacatacaggacaatttattgaagtcaatctcaagcaaaatctgaaatcagtggaatgtcattaaaaacctttccaaattaatcctcacggaagcaaaaaacacattggaattccaaagtatttgtaaaataaaaaaggcaacatctcagtaaatataatgtacaaaaattatatgttcctaccagcacacacatcagtaaagaagcttaaatattacaggcaaccctaaatacactataactagtcaacaataagctatctatatacaggttaaccaagctttacacgtttcacactatgcaataaaacataggccaatcaacaaaatcctcaaaatattatatatcttgaagtctatgtggcaacatcaagtcattatacagtaatgccctagtggaacacccccagggaaaattaacactaatcccttagtgtcaagagcttctagccaagtcacagaaactcaaaagagattgactttagtgaatattgatgctttgttattaaagactcaagtctcaagtgatttaggcaaagtaatggttcacaggatctacaaagtttattacagataaagtacagaaataaccaatctacaaagatcattatcataaagaacacgagaaaatgaaaacggagtctgtaggtatctgtgtttgttgtgcaatatcactcaaatgggtacaaatgagtttctcatatcaattccaaatatacacatacccttgtatataaaaaatgatattagccagttgtaatactcatttagcatcttgattattagtggcaatataattatcttaacatagggcatgtaacaggacaaatgagataaaataatgacaaccaagtaagttttatccagtccatttctaaactgacaagaataccttattcaataccttatataggtcatctgacagatacttgagggctgtttgcacacatcaagtgtgttggcaggcagggaggggagcagtaaaagctgagggtgctttctcactaactagcagatgcagtaatgccacataagaaaactaaggactgaataaatgactttggcatctattctattttccctttttacttacatgtaaattacttttacagcctactgaaggacaggcaattctcatccccctcccgcttcatacatacgtgccacaagcacccaaacttgtcacttatgcaatggactgaccaaaacaaaacaaaaaacagaaatgttttttgaaagacacggattacccacattttgggagtgtaacgtaagtgcaattttttgttttgtttttttccctacatagacatagtaaaaggaaagaagatgtgcttggggagagggttgacaaaatgacaaaataaagaatgtacataaaaagtatttgtaaaaatgctggtatctcatgcaggagtctcttcctcaaatgtgttcaatcaatctgagctatctactgtgaacactctcccatttgcagaacttcacctttaatccacgctaaagaggataagagactaggctatttattttcaaaacagtttacaaaacaatgctttctacttcataaatgtaaaaagaaactaaaataaggagaatctgaagagtttcaagtacttaaaaaacctgaattcaatgaggcagaggtctcaatgttaaagtgactatttcgtacctgtggtaaacattatccccccccttaccctttaccaggagaaagggggttccctttctcctggtaccccaccccaggtaaaagttggtgagatttcagtatatacacatttccaacttttcagtatttgttaattcattgcaaagctgtctaattatagtattccctagtccatctgaaaatggaagcaagttctactttttgttttacaaataaccagagaccaattctaggtggccctaggccaaaggaaagtgtttccattcatcaattcatgtctgcaccaacttggacaactgggggaggctggatgcatcagccttgtgaaaagtaactttagtctacgctgcccagaaataaagcaactttccaatgtcctttttctcatatggaagtatagaatgtcagcttcccagctgtgagggctccatagccactgttttcttatcttgttaagaggacatggcatgtggcagccaacaccttgacttcaaggtgaatgctaaaggaagagctttgtatttaaaatgaaatgaaagacaagcaacaagtcctgggcagtccagagattgtattctctacagatggcctgtttgcaaacagtaggtctgggtttgacctattggaatacaccatgcaagaaactactcaaaaaggaaattccacttcatgaaccaggaaagttgtccaatagcctgtcccatctgagggtcctttacatgattagatactcaatatctcagttccacaacgttatttacagacatgttttcaaatattttgtgtaaatggcagaagggagctgggagcagtccccctgcctccattacttttttagctttcacatatgttcttgacttgtacagaaaatcccaaattttaaatgattccccaactcagccagttctatagatgaggccagatcatttttgagaattaagataagagtgggaacttgttaaaacaaaaatgaaaataaaacccacctcactcctgtatctctccctgattagacattaaagaggtgaatcactgcctctggctgcttcagccttccaggaatgaagagccatccaccttgcccttctcagccagccacaggcagctcttctgattcttccctcgcagcagtggcggtccagcccctccctcccctgcacagtgcctgagaaagtttcccaggatttcatctttagctcttactgatccagtttctgaagctttaggctgattatcaaaaatcttatgttcacttcttccttcaacaaattaacatgtggttaaaaaaaataccaccattagcccatgctgctttaagttatttcattgttggacaagaataaaaaccagccacttacactctgaccacatatagatttaaaagttaacaaataccaacttcagactatgagtgagcaatgtcttttggaatatttcattggtgtatcacaggcacagtgcatgtatactcatgcacacataaaggacaattttctctttctgcatctataatctgcaacttaaaaatatatcaaataggtcaacattgacgctatggaggtgtgaggagaactccttggcaccagcatgactaaaaccgctttttagaccattaaagaacattcatggccaaagacttcagaactatggttaccttttttttttgagatggagtctcgctctgtcacccaggctggagtgcagtgatgtgatcttggctcactgcaacctctgcctcctgagaaactgggactacaggtatgtgccaccatgcccggctcctttttgtatttttagcagagacagggtttcaccatgttggtcaggctggtctcaaactcctgacctcatgatctgcccacctcggcctcccaaagtgctgggattacaggtgtgagccactgcacctggcagctattttgttttctactctgatttctgaaatggtgaaacaatcctattaatcataatttttttttaatttcagcagagctctgttacagatatgaaaacaaaatgtgacacaatgaagaagctgcataaaaatactgaaacctaagcaaaaacatttctttttcaagctgcaatggcactgaagcacaataaaaggcaagaaaagaccaagggaatttaaccctccacaaaagaatcccaaaccaaccaaatcaaacaaaaaccagacaccaccaactgcttctgcctgcatgaactggtttcccatttttgctttaataaggcagttccgatggcaaaggctgtaaaa

SEQ ID NO: 364379 - DNA, 3204 bp, Homo sapiens
actatataatcctttggctatacttttactatatagtagctccccatactttttttttaaatagagactatgttgcccacgttggacttgaactcttgggcttaaacaatcctacctacctacctacctcagggtcctgagtagctgggactacaggtgcatgccgtcatgcccagcttctccacataactattttttattctttagggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccataaaaaaaaat

SEQ ID NO: 364380 - DNA, 2660 bp, Homo sapiens
ctgcacactgatatagaggcgggacgcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccataaaaaaaaat

SEQ ID NO: 364381 - DNA, 2405 bp, Homo sapiens
atgacacctgtcattttttaggatctaaactcagagttttaatggttctgttatctaagagttactgtggcaacagttatgattttaattaccaaccacccatcctgagatttaaattactcagccttttagatgtgaaattacaaagtctgtgtattcgactctggcattctctgtggttgccttccagttgtgactgcagctcttctcccactttcttccctagacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccataaaaaaaaat

SEQ ID NO: 364382 - DNA, 3063 bp, Homo sapiens
ttgtctgtatttatttttgcttattgttgtttttttatctctccttatttataatttccgttgttttatctttttttcggcatttcaatttttttttctcactcttgtctacgcctctataagtgcttttttccctgtcttcgacgtgggtgcgtggttgtgtttccccactggttgtattgtctgtctacgctcgtcgcactaccgtaggggtatagaaagctaggtttgtttacgtcctgctgttctacatggcatgtcgccgcaacggttgcctcaacgctggttttttttggcttcagttgtctgcaccggtgctgtttgttgactggacatgtttgtcctttcttagattctaattagctcgtgttgatattttccgttggtgcttcctattttgtgttgttctcccttgtgtctattcttcttattttcttctggtgtagtttcttctttatttttttttttctctcttttttgtttttttttttttttttttccttttttttttttttttttttttttttttttttttttaatttggaacatacaggacaatttattgaagtcaatctcaagcaaaatctgaaatcagtggaatgtcattaaaaacctttccaaattaatcctcacggaagcaaaaaacacattggaattccaaagtatttgtaaaataaaaaaggcaacatctcagtaaatataatgtacaaaaattatatgttcctaccagcacacacatcagtaaagaagcttaaatattacaggcaaccctaaatacactataactagtcaacaataagctatctatatacaggttaaccaagctttacacgtttcacactatgcaataaaacataggccaatcaacaaaatcctcaaaatattatatatcttgaagtctatgtggcaacatcaagtcattatacagtaatgccctagtggaacacccccagggaaaattaacactaatcccttagtgtcaagagcttctagccaagtcacagaaactcaaaagagattgactttagtgaatattgatgctttgttattaaagactcaagtctcaagtgatttaggcaaagtaatggttcacaggatctacaaagtttattacagataaagtacagaaataaccaatctacaaagatcattatcataaagaacacgagaaaatgaaaacggagtctgtaggtatctgtgtttgttgtgcaatatcactcaaatgggtacaaatgagtttctcatatcaattccaaatatacacatacccttgtatataaaaaatgatattagccagttgtaatactcatttagcatcttgattattagtggcaatataattatcttaacatagggcatgtaacaggacaaatgagataaaataatgacaaccaagtaagttttatccagtccatttctaaactgacaagaataccttattcaataccttatataggtcatctgacagatacttgagggctgtttgcacacatcaagtgtgttggcaggcagggaggggagcagtaaaagctgagggtgctttctcactaactagcagatgcagtaatgccacataagaaaactaaggactgaataaatgactttggcatctattctattttccctttttacttacatgtaaattacttttacagcctactgaaggacaggcaattctcatccccctcccgcttcatacatacgtgccacaagcacccaaacttgtcacttatgcaatggactgaccaaaacaaaacaaaaaacagaaatgttttttgaaagacacggattacccacattttgggagtgtaacagagctctgttacagatatgaaaacaaaatgtgacacaatgaagaagctgcataaaaatactgaaacctaaggtatctgtagtatataggatgtaccctggcttaccatagaaaagtctttagatagtaaatagcactaagtctaaaagcaaggagataagatttcatgttggatactgtttcaagaactgtatttggaatattaaaggaaatccttatgttagtaagtttaaaaaaccaaacatcatatacaaaataaaattttagtatgataaaacctagcttttcttattttttaaaaggacatcaaactatataattgctcaagagcaaagtttagtgttttggtgagctgtatttcatgttacttgtagcaattatatttggtgacatggatcgcattttccattttgctctttcttttgggaccatatctaatcaacagaagtactggaagcccaatgagtcaccgcagaattaattgctggagtcaggcaaatggcagtttaggagcttcagtaaaagaattgtagtgttttttacaagagaaaatccagtataattgcacatttacatacaaaaaaaagaggcacaaaacagattttcaccctctttccatagaagagctctaaattgataagcaaatggaacactcaatacagctgaaggaatgtggtagagcatctaccctccctaccttcataaggttactaggtacttgagggaaaataaatgctaccaggtaccagcaattgtaagcagtcaaaattcacagagaaagttaacattcattcaagctaaccctagacttctacttagtacagtgttacaacaatgtctgacattactaattattttcatacaaggaatactggaatatacatattcctaagcattaaaagcaagtgagtttggtgagcagacatcttggtatactcgcatctataagagtcaagcatcaccatcaaccatttttgctaacactgactttcttgggagttttctccaagtgcttcctaagatgaagtgtgtttgtgtggctcttatgcaccctgtaaaagtagaagttcttccccttactcaatgggagcaatcttaagtactggataataatagaaattctttacatgtaacctggggatgcccctactactttcaccccccaaattaggaactcaaccaaaaagatctattcaaatacaattcaaactcacttgtgtggttttaccaggaaacatgactgaatggtc

SEQ ID NO: 364383 - DNA, 2482 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatgtaagttttaaaatgtcatatatatagtgtaattcttacatattaacatgttataatgaactatggagcctcaagctctttttaaatatactagctgttgcctgtcaa

SEQ ID NO: 364384 - DNA, 2482 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcat

SEQ ID NO: 364385 - DNA, 2011 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagttgagattagcatcacttcgtctactaagaatcttaatagatgtaaaaatatcttttaaaacatatggtaggatgggtaaaatttggcaatactatccaggaagtcactaagtacagatgaactgatttagtcctaattccaagaagtgtgattccacctacttgactagaaatttatacctggtaataactccttgtccttgaagattttcaactaaggaaaactgtttttcagcaggacctgattatgcactgctatctaggtagggtcacttatggttttataatatatttaattggattataatattccttttttcttgtctcttggacaaaatcctagctttactgtaatttaaaaagatgagtttaaaatttcaggctttaaaaacataccaaacattgataaaaatgaaatactagataaaagtattttatcaatgttcagttgcctggattcaataactgtattatggttatgtaagataatatacttaggaaatacacattatggtattaaagggttaaagaggtatggtgcatgcaacctgatgatgtatgtagtctgctttctaatgattcagaaaaataaatgtgtgtgtgtgtgtgtgtacacacacagagaatcataaagcaaatgtaattgttaaaaagttgaatctctgtaaaaagtatgtgggagtgtctgtactatgctttctagttttctgtacatttctagttatttagaaataaaaagttttaaaaacctggctgcacgtggtggctcatgcctgtaatcccagcacttggggaggccaaggtggaaggatcacttgagcccaggagttcgagaccagcctgggcaatatggcgaaaccctgtctgtacaaaaaatacaaaaattaactgggcatggtggcacacatctgtagtctcagctattttggaggctgaggcaggaggatcactcgagcccagaaggttgaggctggaatgagtgtttatcatgccactgcactccagcctaggcgacagagtgagactctgtctcaaaaaaaaaagtc

SEQ ID NO: 364386 - DNA, 1102 bp, Homo sapiens
ttgtctgtatttatttttgcttattgttgtttttttatctctccttatttataatttccgttgttttatctttttttcggcatttcaatttttttttctcactcttgtctacgcctctataagtgcttttttccctgtcttcgacgtgggtgcgtggttgtgtttccccactggttgtattgtctgtctacgctcgtcgcactaccgtaggggtatagaaagctaggtttgtttacgtcctgctgttctacatggcatgtcgccgcaacggttgcctcaacgctggttttttttggcttcagttgtctgcaccggtgctgtttgttgactggacatgtttgtcctttcttagattctaattagctcgtgttgatattttccgttggtgcttcctattttgtgttgttctcccttgtgtctattcttcttattttcttctggtgtagtttcttctttatttttttttttctctcttttttgtttttttttttttttttttccttttttttttttttttttttttttttttttttttttaatttggaacatacaggacaatttattgaagtcaatctcaagcaaaatctgaaatcagtggaatgtcattaaaaacctttccaaattaatcctcacggaagcaaaaaacacattggaattccaaagtatttgtaaaataaaaaaggcaacatctcagtaaatataatgtacaaaaattatatgttcctaccagcacacacatcagtaaagaagcttaaatattacaggcaaccctaaatacactataactagtcaacaataagctatctatatacaggttaaccaagctttacacgtttcacactatgcaataaaacataggccaatcaacctcgtgccgaattcggcacgagatcagcaaggaaatttttgcacctcttgatgaaaggatgctgggagctgtccaagtcaagaggaggacaaagagcctgtcagtgacaaacaagatacccacacaggcgtccatcacaaaggtcaaacagtttgaaggctccacatcatttgttccgagatcacagtggatgctcgagcagcttcgccaggttaatggtttcgatcctaatgg

SEQ ID NO: 364387 - DNA, 890 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagc

SEQ ID NO: 364388 - DNA, 764 bp, Homo sapiens
cggacgcgtgggtcgacccacgcgtcggaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcat

SEQ ID NO: 364389 - DNA, 4382 bp, Homo sapiens
agcggggtcgcgcgccgcgctccccgccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccataaaaaaaaat

SEQ ID NO: 364390 - DNA, 5456 bp, Homo sapiens
ttgtctgtatttatttttgcttattgttgtttttttatctctccttatttataatttccgttgttttatctttttttcggcatttcaatttttttttctcactcttgtctacgcctctataagtgcttttttccctgtcttcgacgtgggtgcgtggttgtgtttccccactggttgtattgtctgtctacgctcgtcgcactaccgtaggggtatagaaagctaggtttgtttacgtcctgctgttctacatggcatgtcgccgcaacggttgcctcaacgctggttttttttggcttcagttgtctgcaccggtgctgtttgttgactggacatgtttgtcctttcttagattctaattagctcgtgttgatattttccgttggtgcttcctattttgtgttgttctcccttgtgtctattcttcttattttcttctggtgtagtttcttctttatttttttttttctctcttttttgtttttttttttttttttttccttttttttttttttttttttttttttttttttttttaatttggaacatacaggacaatttattgaagtcaatctcaagcaaaatctgaaatcagtggaatgtcattaaaaacctttccaaattaatcctcacggaagcaaaaaacacattggaattccaaagtatttgtaaaataaaaaaggcaacatctcagtaaatataatgtacaaaaattatatgttcctaccagcacacacatcagtaaagaagcttaaatattacaggcaaccctaaatacactataactagtcaacaataagctatctatatacaggttaaccaagctttacacgtttcacactatgcaataaaacataggccaatcaacaaaatcctcaaaatattatatatcttgaagtctatgtggcaacatcaagtcattatacagtaatgccctagtggaacacccccagggaaaattaacactaatcccttagtgtcaagagcttctagccaagtcacagaaactcaaaagagattgactttagtgaatattgatgctttgttattaaagactcaagtctcaagtgatttaggcaaagtaatggttcacaggatctacaaagtttattacagataaagtacagaaataaccaatctacaaagatcattatcataaagaacacgagaaaatgaaaacggagtctgtaggtatctgtgtttgttgtgcaatatcactcaaatgggtacaaatgagtttctcatatcaattccaaatatacacatacccttgtatataaaaaatgatattagccagttgtaatactcatttagcatcttgattattagtggcaatataattatcttaacatagggcatgtaacaggacaaatgagataaaataatgacaaccaagtaagttttatccagtccatttctaaactgacaagaataccttattcaataccttatataggtcatctgacagatacttgagggctgtttgcacacatcaagtgtgttggcaggcagggaggggagcagtaaaagctgagggtgctttctcactaactagcagatgcagtaatgccacataagaaaactaaggactgaataaatgactttggcatctattctattttccctttttacttacatgtaaattacttttacagcctactgaaggacaggcaattctcatccccctcccgcttcatacatacgtgccacaagcacccaaacttgtcacttatgcaatggactgaccaaaacaaaacaaaaaacagaaatgttttttgaaagacacggattacccacattttgggagtgtaacgtaagtgcaattttttgttttgtttttttccctacatagacatagtaaaaggaaagaagatgtgcttggggagagggttgacaaaatgacaaaataaagaatgtacataaaaagtatttgtaaaaatgctggtatctcatgcaggagtctcttcctcaaatgtgttcaatcaatctgagctatctactgtgaacactctcccatttgcagaacttcacctttaatccacgctaaagaggataagagactaggctatttattttcaaaacagtttacaaaacaatgctttctacttcataaatgtaaaaagaaactaaaataaggagaatctgaagagtttcaagtacttaaaaaacctgaattcaatgaggcagaggtctcaatgttaaagtgactatttcgtacctgtggtaaacattatccccccccttaccctttaccaggagaaagggggttccctttctcctggtaccccaccccaggtaaaagttggtgagatttcagtatatacacatttccaacttttcagtatttgttaattcattgcaaagctgtctaattatagtattccctagtccatctgaaaatggaagcaagttctactttttgttttacaaataaccagagaccaattctaggtggccctaggccaaaggaaagtgtttccattcatcaattcatgtctgcaccaacttggacaactgggggaggctggatgcatcagccttgtgaaaagtaactttagtctacgctgcccagaaataaagcaactttccaatgtcctttttctcatatggaagtatagaatgtcagcttcccagctgtgagggctccatagccactgttttcttatcttgttaagaggacatggcatgtggcagccaacaccttgacttcaaggtgaatgctaaaggaagagctttgtatttaaaatgaaatgaaagacaagcaacaagtcctgggcagtccagagattgtattctctacagatggcctgtttgcaaacagtaggtctgggtttgacctattggaatacaccatgcaagaaactactcaaaaaggaaattccacttcatgaaccaggaaagttgtccaatagcctgtcccatctgagggtcctttacatgattagatactcaatatctcagttccacaacgttatttacagacatgttttcaaatattttgtgtaaatggcagaagggagctgggagcagtccccctgcctccattacttttttagctttcacatatgttcttgacttgtacagaaaatcccaaattttaaatgattccccaactcagccagttctatagatgaggccagatcatttttgagaattaagataagagtgggaacttgttaaaacaaaaatgaaaataaaacccacctcactcctgtatctctccctgattagacattaaagaggtgaatcactgcctctggctgcttcagccttccaggaatgaagagccatccaccttgcccttctcagccagccacaggcagctcttctgattcttccctcgcagcagtggcggtccagcccctccctcccctgcacagtgcctgagaaagtttcccaggatttcatctttagctcttactgatccagtttctgaagctttaggctgattatcaaaaatcttatgttcacttcttccttcaacaaattaacatgtggttaaaaaaaataccaccattagcccatgctgctttaagttatttcattgttggacaagaataaaaaccagccacttacactctgaccacatatagatttaaaagttaacaaataccaacttcagactatgagtgagcaatgtcttttggaatatttcattggtgtatcacaggcacagtgcatgtatactcatgcacacataaaggacaattttctctttctgcatctataatctgcaacttaaaaatatatcaaataggtcaacattgacgctatggaggtgtgaggagaactccttggcaccagcatgactaaaaccgctttttagaccattaaagaacattcatggccaaagacttcagaactatggttaccttttttttttgagatggagtctcgctctgtcacccaggctggagtgcagtgatgtgatcttggctcactgcaacctctgcctcctgagaaactgggactacaggtatgtgccaccatgcccggctcctttttgtatttttagcagagacagggtttcaccatgttggtcaggctggtctcaaactcctgacctcatgatctgcccacctcggcctcccaaagtgctgggattacaggtgtgagccactgcacctggcagctattttgttttctactctgatttctgaaatggtgaaacaatcctattaatcataatttttttttaatttcagcagagctctgttacagatatgaaaacaaaatgtgacacaatgaagaagctgcataaaaatactgaaacctaaggtatctgtagtatataggatgtaccctggcttaccatagaaaagtctttagatagtaaatagcactaagtctaaaagcaaggagataagatttcatgttggatactgtttcaagaactgtatttggaatattaaaggaaatccttatgttagtaagtttaaaaaaccaaacatcatatacaaaataaaattttagtatgataaaacctagcttttcttattttttaaaaggacatcaaactatataattgctcaagagcaaagtttagtgttttggtgagctgtatttcatgttacttgtagcaattatatttggtgacatggatcgcattttccattttgctctttcttttgggaccatatctaatcaacagaagtactggaagcccaatgagtcaccgcagaattaattgctggagtcaggcaaatggcagtttaggagcttcagtaaaagaattgtagtgttttttacaagagaaaatccagtataattgcacatttacatacaaaaaaaagaggcacaaaacagattttcaccctctttccatagaagagctctaaattgataagcaaatggaacactcaatacagctgaaggaatgtggtagagcatctaccctccctaccttcataaggttactaggtacttgagggaaaataaatgctaccaggtaccagcaattgtaagcagtcaaaattcacagagaaagttaacattcattcaagctaaccctagacttctacttagtacagtgttacaacaatgtctgacattactaattattttcatacaaggaatactggaatatacatattcctaagcattaaaagcaagtgagtttggtgagcagacatcttggtatactcgcatctataagagtcaagcatcaccatcaaccatttttgctaacactgactttcttgggagttttctccaagtgcttcctaagatgaagtgtgtttgtgtggctcttatgcaccctgtaaaagtagaagttcttccccttactcaatgggagcaatcttaagtactggataataatagaaattctttacatgtaacctggggatgcccctactactttcaccccccaaattaggaactcaaccaaaaagatctattcaaatacaattcaaactcacttgtgtggttttaccaggaaacatgactgaatggtc

SEQ ID NO: 364391 - DNA, 2916 bp, Homo sapiens
tattaatgagagatgcttttattttcctcctttgaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccataaaaaaaaat

SEQ ID NO: 364392 - DNA, 2590 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcat

SEQ ID NO: 364393 - DNA, 2711 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatgtatccataatccacaaagcatatttaaaaggctcttggcacgggcagcattggttgagcagagagctctgttacagatatgaaaacaaaatgtgacacaatgaagaagctgcataaaaatactgaaacctaagcaaaaacatttctttttcaagctgcaatggcactgaagcacaataaaaggcaagaaaagaccaagggaatttaaccctccacaaaagaatcccaaaccaaccaaatcaaacaaaaaccagacaccaccaactgcttctgcctgcatgaactggtttcccatttttgctttaataaggcagttccgatggcaaaggctgtaaaa

SEQ ID NO: 364394 - DNA, 1777 bp, Homo sapiens
ctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatggtatgtgcctaatacagcttgttggactaaacaattctttgatgtccatagtgtgtccttgtgctttgtgggatgtttactctggggagccaagcagttttttggtaattgatctttggctctttttttttgagacagggtctcgctctgtcactcaggctggagtgcagtggtgtgatcccagctcattgcaacctctgcctcccgggttcaagcgattc

SEQ ID NO: 364395 - DNA, 3801 bp, Homo sapiens
gggaaacagaggcccgaggggaggcccggcctacaagacccagaagccttagcgccggcaaggcggccagaagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgccagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 364396 - DNA, 763 bp, Homo sapiens
agcggccgctcgcgatctagaactagggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatcta

SEQ ID NO: 364397 - DNA, 408 bp, Homo sapiens
cagactcagacccgggctgcatactatcctcctagccaaattgctcaactaagaccaagtcctcgctggactgctcagggtgccagacctcatccattccaaaatatgcccgcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 364398 - DNA, 4011 bp, Homo sapiens
gggaaacagaggcccgaggggaggcccggcctacaagacccagaagccttagcgccggcaaggcggccagaagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgccagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaaaaaaaaaaaaaaaggggcgctagagtatctcagggcagttacctaccgttttgccagtgccatgggcgttaaagcagccggcgcgttccctcctgctggaactgactggtctggaggctcttctggggcatgccccccagtagcagataattagtagtacccgctttggtggattgcgtgtattccccgctacatctccccaaacaaatt

SEQ ID NO: 364399 - DNA, 2693 bp, Homo sapiens
agcggccgctcgcgatctagaactagggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgccagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 364400 - DNA, 1871 bp, Homo sapiens
gggaaacagaggcccgaggggaggcccggcctacaagacccagaagccttagcgccggcaaggcggccagaagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatcta

SEQ ID NO: 364401 - DNA, 1048 bp, Homo sapiens
gggaaacagaggcccgaggggaggcccggcctacaagacccagaagccttagcgccggcaaggcggccagaagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagcttgtgactgggacagtgaaaataaacgattggctcttatcaatcaaaaaaaaaaaa

SEQ ID NO: 364402 - DNA, 1068 bp, Homo sapiens
gggaaacagaggcccgaggggaggcccggcctacaagacccagaagccttagcgccggcaaggcggccagaagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattaccaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 364403 - DNA, 2090 bp, Homo sapiens
gggaaacagaggcccgaggggaggcccggcctacaagacccagaagccttagcgccggcaaggcggccagaagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaata

SEQ ID NO: 364404 - DNA, 3562 bp, Homo sapiens
aagaaatatttataggtcgttactcgtgtttttaatttcagttacgatgggctagccattctgagaagataggtggccctggcacacactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgccagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 364405 - DNA, 1493 bp, Homo sapiens
aagggttacggctaggtagcgaggccgggttttaatcggccgaggcagatcatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 364406 - DNA, 1253 bp, Homo sapiens
gggaaacagaggcccgaggggaggcccggcctacaagacccagaagccttagcgccggcaaggcggccagaagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 364407 - DNA, 2155 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364408 - DNA, 438 bp, Homo sapiens
cctgagacaggccctgggacaggccctgggagatgggggctcagtgtgtggccctggatacctctctgtcctttcctgagctttgatatctactgagaactgagggtggtaacgggggacagtgcataatctgggaccaggcaggtgtttgggggccccaaggtgtccagtgtgatcatgccctcaacccctgcccacccacatccaggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364409 - DNA, 1932 bp, Homo sapiens
  misc_feature (17)..(17): n is a, c, g, or t
gcaggctgtaccggccnggggtaatggatcggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364410 - DNA, 1869 bp, Homo sapiens
gtctacatgcccctcagcgctgggcaaatgctttctttccggagtcactgtggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364411 - DNA, 2496 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtgaggcagccaggccgcgtggggagacctgcggcccgggtctcctgcatttaccccaccaggctctcccgcagccccctcacaccccgccttcgacagaacctcccctcaacctcttaacctcatggccccaggcgaagcccggccggccacggccccttccccgagggcgctaggacccctaggttctgcccctgcaggccccgccgtctcttctagccgcaccccatccgggtctgcagaccccaccctcctgaggcccctttccattagcccctgctccacgataagcccgcctctcgcaggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364412 - DNA, 3060 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccgtgagtgccccgccggccaagcggggcgcggctgtcacagcccagcccaccattcacagggtctcggcctcctcgtcctcatcttcaaaatgggaacaacagcgttattgggaggcgtgcgattaagcgagacaatccctgtaaagcgcttagcacgaggcctggcacgtgttcgggatggtggctgggggagcccacaggcaggggagaaggctctgggagggcccctcctcacctcgggttctcacctccccagctacgtcaaaagctacctcctcccggataagcagagcaagcgcaagacggcggtgaagaaacggaatctgaatccggttttcaacgagactctccgggtgaggctgtgaccacgatgcggttccccgttaatgaactggacgcccccttcctgcggggctaggtggcaagggcagccagtaacgtcattgcccggaggatcggcggagggggcccattaactcgttatccagtgttgtcagcctcgtggtgggcgtggtgatagtgcaggtccccattaatgcccttaggggctccccagaattccatcatggtaggaacgcggtaggacctgcctcagccaactcgcgcagcatctacgcgggccaccagcagtgctccactaaagctcacctcctgtcctcagtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtgaggcagccaggccgcgtggggagacctgcggcccgggtctcctgcatttaccccaccaggctctcccgcagccccctcacaccccgccttcgacagaacctcccctcaacctcttaacctcatggccccaggcgaagcccggccggccacggccccttccccgagggcgctaggacccctaggttctgcccctgcaggccccgccgtctcttctagccgcaccccatccgggtctgcagaccccaccctcctgaggcccctttccattagcccctgctccacgataagcccgcctctcgcaggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364413 - DNA, 2447 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccgtgagtgccccgccggccaagcggggcgcggctgtcacagcccagcccaccattcacagggtctcggcctcctcgtcctcatcttcaaaatgggaacaacagcgttattgggaggcgtgcgattaagcgagacaatccctgtaaagcgcttagcacgaggcctggcacgtgttcgggatggtggctgggggagcccacaggcaggggagaaggctctgggagggcccctcctcacctcgggttctcacctccccagctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364414 - DNA, 1467 bp, Homo sapiens
ctgtgctttgggacggcgctgtgcttgggacggcggtgaagaaacggaatctgaatccggttttcaacgagactctccgggtgaggctgtgaccacgatgcggttccccgttaatgaactggacgcccccttcctgcggggctaggtggcaagggcagccagtaacgtcattgcccggaggatcggcggagggggcccattaactcgttatccagtgttgtcagcctcgtggtgggcgtggtgatagtgcaggtccccattaatgcccttaggggctccccagaattccatcatggtaggaacgcggtaggacctgcctcagccaactcgcgcagcatctacgcgggccaccagcagtgctccactaaagctcacctcctgtcctcagtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtgaggcagccaggccgcgtggggagacctgcggcccgggtctcctgcatttaccccaccaggctctcccgcagccccctcacaccccgccttcgacagaacctcccctcaacctcttaacctcatggccccaggcgaagcccggccggccacggccccttccccgagggcgctaggacccctaggttctgcccctgcaggccccgccgtctcttctagccgcaccccatccgggtctgcagaccccaccctcctgaggcccctttccattagcccctgctccacgataagcccgcctctcgcaggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364415 - DNA, 769 bp, Homo sapiens
ggatgacactctgttcgtgaggttcgacatcgacgccacgagtccgaggaaggatccacgggcgccatggatagagcaggaggggccggagtattgggaccgggagacacagatctccaagtccaacacacagacttaccgagcacacagcccggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364416 - DNA, 217 bp, Homo sapiens
cagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagc

SEQ ID NO: 364417 - DNA, 184 bp, Homo sapiens
cacgccctgaaaagcgggagactccagtccccgggtttgggggcggtggactccatccgtgtgcgggcctgagccgagcctctccgcaggcgcaggactgcccccgagcggggagctgcacttctgggtgaaggaggctcgggacctcctgccgctgcgggcaggatccctggacacttacgta

SEQ ID NO: 364418 - DNA, 2191 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364419 - DNA, 862 bp, Homo sapiens
  misc_feature (1)..(1): n is a, c, g, or t
  misc_feature (21)..(21): n is a, c, g, or t
  misc_feature (26)..(26): n is a, c, g, or t
  misc_feature (31)..(31): n is a, c, g, or t
  misc_feature (34)..(36): n is a, c, g, or t
naatatgcaggctggtactgncccgnagttntgnnntcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccaggtaggcgggagtggcccgtggctgctctcaacatccggagcggactccgggcggggagcgctcctgcccagggctgcgagccgcccgcgaccca

SEQ ID NO: 364420 - DNA, 1914 bp, Homo sapiens
  misc_feature (1)..(1): n is a, c, g, or t
  misc_feature (21)..(21): n is a, c, g, or t
  misc_feature (26)..(26): n is a, c, g, or t
  misc_feature (31)..(31): n is a, c, g, or t
  misc_feature (34)..(36): n is a, c, g, or t
naatatgcaggctggtactgncccgnagttntgnnntcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364421 - DNA, 2804 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccgggtgaggctgtgaccacgatgcggttccccgttaatgaactggacgcccccttcctgcggggctaggtggcaagggcagccagtaacgtcattgcccggaggatcggcggagggggcccattaactcgttatccagtgttgtcagcctcgtggtgggcgtggtgatagtgcaggtccccattaatgcccttaggggctccccagaattccatcatggtaggaacgcggtaggacctgcctcagccaactcgcgcagcatctacgcgggccaccagcagtgctccactaaagctcacctcctgtcctcagtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtgaggcagccaggccgcgtggggagacctgcggcccgggtctcctgcatttaccccaccaggctctcccgcagccccctcacaccccgccttcgacagaacctcccctcaacctcttaacctcatggccccaggcgaagcccggccggccacggccccttccccgagggcgctaggacccctaggttctgcccctgcaggccccgccgtctcttctagccgcaccccatccgggtctgcagaccccaccctcctgaggcccctttccattagcccctgctccacgataagcccgcctctcgcaggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364422 - DNA, 2032 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364423 - DNA, 2255 bp, Homo sapiens
cagctgggaggcacacgcctcagcctgggcaccggcagcagctatgggctgcaggtgccctggatggattccacacctgaggagaggctcagggagactgaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccgtgagtgccccgccggccaagcggggcgcggctgtcacagcccagcccaccattcacagggtctcggcctcctcgtcctcatcttcaaaatgggaacaacagcgttattgggaggcgtgcgattaagcgagacaatccctgtaaagcgcttagcacgaggcctggcacgtgttcgggatggtggctgggggagcccacaggcaggggagaaggctctgggagggcccctcctcacctcgggttctcacctccccagctacgtcaaaagctacctcctcccggataagcagagcaagcgcaagacggcggtgaagaaacggaatctgaatccggttttcaacgagactctccgggtgaggctgtgaccacgatgcggttccccgttaatgaactggacgcccccttcctgcggggctaggtggcaagggcagccagtaacgtcattgcccggaggatcggcggagggggcccattaactcgttatccagtgttgtcagcctcgtggtgggcgtggtgatagtgcaggtccccattaatgcccttaggggctccccagaattccatcatggtaggaacgcggtaggacctgcctcagccaactcgcgcagcatctacgcgggccaccagcagtgctccactaaagctcacctcctgtcctcagtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtgaggcagccaggccgcgtggggagacctgcggcccgggtctcctgcatttaccccaccaggctctcccgcagccccctcacaccccgccttcgacagaacctcccctcaacctcttaacctcatggccccaggcgaagcccggccggccacggccccttccccgagggcgctaggacccctaggttctgcccctgcaggccccgccgtctcttctagccgcaccccatccgggtctgcagaccccaccctcctgaggcccctttccattagcccctgctccacgataagcccgcctctcgcaggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 364424 - DNA, 310 bp, Homo sapiens
gggcagtgagggtctaaggccaggcaggcaggagccaggggacatggacatatgtgagagagaatgagtgggacgtggtgactggatgactctagggagtgtgaggggggtcacctgatgccaggccacctcccgcacagcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaacc

SEQ ID NO: 364425 - DNA, 2799 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggac

SEQ ID NO: 364426 - DNA, 6144 bp, Homo sapiens
  misc_feature (6034)..(6034): n is a, c, g, or t
  misc_feature (6055)..(6055): n is a, c, g, or t
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaaaaaaaaaaagaaantttggggcgcggcccagaaantttaaacacttgtgggggggcgagggatggcagtgccaggtcaggaacgcgaagggggtcccaaaaacgggcggcctaacaagtggtcg

SEQ ID NO: 364427 - DNA, 6206 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaaaacacaacaaaaaaaaaaaaaaaaaaaaaaaaaaaaaataatcataaaaatctatcctatagaatagatgattggaaactgtgctgtagagtgaagaaccacagcaaacgactgagcccggaaacgactgtacctaagcaattagagataactagacggacttgagcgaggggggaaattggtctt

SEQ ID NO: 364428 - DNA, 6026 bp, Homo sapiens
  misc_feature (5200)..(5200): n is a, c, g, or t
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgcggcngggcgtgcgcgcggtgggcgtggcggcgggcgccggcgttggggccggggggggcccgcctggccggcgccggcgccgcgcccgcgcccgccggggcgcggcggggtgggcgggcgcccgccgcgcgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaa

SEQ ID NO: 364429 - DNA, 1892 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggtttttatacaccccgcagcctcctattacttctaatactccctgattttagtgtcagcctcatcccaggtctcgcttccatcccaagggggacagtgttccttctctccaacccccccacccccctccaactcaggctcggtctttggcccaggcttcgagcatgggcctctgggggggagggagtggggaggataaagggtggagtcccacttccgctttccaactccctttttaggccaccgcattgtatatcccgacacacacacgctttgaatagagccctttggggtgggggagacttaaaggcagtttgtggtttggggaagtaagagttaacataagccattttaattccctgggaagtgggagagtgggtctcccattttccccaagcaccctttttggtaattgtgttctgtgggttggaaggaggtgaagggggacctgggagcgagctgttggtgggtgggaatagggatttggccccgagtggagcagccgcctgttaggagcccaacatggcgcctgaaaagcacatgatgcgaaagggaagagaggagaatccattccctgccagccaggcagctgctcactcccgtcagccccattttggggtgggggcggctagataaaacttttattctcctattggagggtctaatttgtcccaaaataggggcaagtggggttgagggtggggtttgggtggggggaggagatcttatccaacctgtaggtggagaactggcccagagggtaacaagtacttgcagtttctctgaaaagttcagtccctcctcctcttccttttctctttttctcccttccctgatagcgaaggagtgtttttctttaccccttgacagaagtggtcctctgccaccttatatttccctgtagtcctcctcttctgtggattcatatgggagcgatatgtcatttaagtaaagttactgttcaacttagttacaatgagttttaatagcgtcccagtgctacattttatttttcaagcttgtactcacggtttagttttttctagttgttagtgattgcaattatcaggatgagcctccttttagcagagtgaacccctttttaaaggccactttaacaacaaccaccaatatattgtttagagacggtttctgtctagtgtaaaacttgagtggtctgactctaataaatggttttgaaatgtgtgactggtattataaaatttgtgaataaaacatataaaatatg

SEQ ID NO: 364430 - DNA, 183 bp, Homo sapiens
gcaggacatcttgaagaaaactttgaaaaatgcttagtataatttgcatctttaagttctacattcacttcaaaagtggttttttttctttctttcttttttttgttaggagccctccctaaggcatatcctgataatcatctcagtcaggtggatgtaaatgaattgttttcaaaattgcta

SEQ ID NO: 364431 - DNA, 284 bp, Homo sapiens
ttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcggtaagttttaatatgaatagtaagtaacatacttttaagtatcacattttgaattcttctgcagaacttactgccagaaagtcaaaatagaatactcggtagtgaattggttcaatttg

SEQ ID NO: 364432 - DNA, 811 bp, Homo sapiens
gtaattttcatttctttataaggaagtgttaagattagtgtttttttgttgggttaacacattactttgaaaggaggcggttcataatagtttttgtttgatttttggtcttaataaaaagggtattggactttagtaatagaatgtttgaattagaagggatcttagcagtcacccggttctgtacactttacacaggaggttgcactattagtcagtgacagacccaggactaggtcttctgaatctagttagtcgtttttctgtcgacccacactattttgattgtggatttatatttcatcatcaaactatactgtgctgaaaacaaagcaagttaggctagatacttaaatgggccaagagaagtcagtttttcagactctttaagcataaggatgaaaatttggttttatccattttgggaccaaataatttttgtcttctttccaaagactatcttctggcttaaagttaaaaagaaatatcagaatagcccattagaaatgaatacgcacatatttactttttttctttttgcttcagatttatcatccatcatgttatgaagattatcaaaatgtaagttctttttggttactgtatttgttctcatttgcattaataaattttacttttcagttttttttttgcatcagagcaatattgttattttaaacttaatatattgaactgtttttgttttttgatatagcatttaggttgttcagtaaaaactggtgccagattgacagaattgacatatatgaatatcattttctgtgataacgcaaacaattaaaattttgaa

SEQ ID NO: 364433 - DNA, 770 bp, Homo sapiens
gtttgttcacttacttggtcttctatatatacctgtttcttcccaaatagggagcccagaatttaaaaaactaattatttgttgaccacagcaaactaattattgtttcccaatggtattctaagttttctctttagttatccatactattattatttcttctgtccttttttcactgttacaccagagtggagaagttgaattattcagaatgccaaagatctagagaggtgaaatttaactgttctgccatgtccatcttgacttgactccaaactaaaataagctaactattgccttgttagctagcacaggatcatttcatttttagctaaaaggaaataaataactgggtcagggctatcaataagaagacaggctccatcttccaaaagtcaccaaagttaaggtaaagagggtcaatcacattgttagagaataatactgatctttgggtattaactgtttcagccagctcttggtttcaccattgttacagtatggaaaattgaaatatttgtaattggcttttaaaggccattaagccatattatcaacactaaagattatttctttttcaaaatagacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaaca

SEQ ID NO: 364434 - DNA, 6020 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaa

SEQ ID NO: 364435 - DNA, 992 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagtgtttttctttaccccttgacagaagtggtcctctgccaccttatatttccctgtagtcctcctcttctgtggattcatatgggagcgatatgtcatttaagtaaagttactgttcaacttagttacaatgagttttaatagcgtcccagtgctacattttatttttcaagcttgtactcacggtttagttttttctagttgttagtgattgcaattatcaggatgagcctccttttagcagagtgaacccctttttaaaggccactttaacaacaaccaccaatatattgtttagagacggtttctgtctagtgtaaaacttgagtggtctgactctaataaatggttttgaaatgtgtgactggtattataaaatttgtgaataaaacatataaaatatg

SEQ ID NO: 364436 - DNA, 6757 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaactttgtttgtacttctttatttcttgaaaagctttagaatgtgactttcttgttgtctttcatctgttttttgaaacatgaacatggtacttgctatgagccaggcactctgagacaggttagtcttttctgccatttattggagataggcatataaaacactgagttttattgagcacatagtatgtggcaggcactagcactttctacatgtattttctctggtattcacatctaataactacatggtagatggtgtccccactttacagatgaaattaagccactcactttaaaatttttataagaatttgaacgtggctttgtttcctctaattccatacaatttctgcaattttaaaagatacccccaaattgattgttaggatagaaataagcacaccaaactactggaaggtggctaaggaagattctacaaaagtggtgacatttgagtcttggaggataaccaggagtggagtccatactgatgggaagggtatctttggaaaatgaacagcaaatgtaaaggcttaaaatacttttgtgttttcaaaaattgacttcttatggttaaaactcagtagttttgaatagattatgatgagccattaatttttttagtagaaatggagtctcactacgtagtccaggctggtttcgaattcctgggctcaagtgatcctactgccttggcctcccagagtgctgggattacaggcatgagccacgtgccc

SEQ ID NO: 364437 - DNA, 3866 bp, Homo sapiens
aacatagatgcaatgtacgggatagtcctacagaagaaaataaaggtggattaaaaaagaaacctctcttatctgatgctgaattaacctactatgaacataaagcaaaactgaaaaggacacaggttcagcattcatttccaagacttgatctcttagatcctgatatttttgactaccctttgactgatgccttgttgtctggaatagaatgtgagccatccaaaagtaaacatgcaagtaggaatagtggagcacagtttgacagaaaagaacaatttagtgaaagagcaagacgtctttctcctatatctgggagtcgtacttatgctgagaatctttcaccccatgagggccggagaagacatgacgagcaagtctctgctaaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaa

SEQ ID NO: 364438 - DNA, 1564 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggtttttatacaccccgcagcctcctattacttctaatactccctgattttagtgtcagcctcatcccaggtctcgcttccatcccaagggggacagtgttccttctctccaacccccccacccccctccaatgttggtgggtgggaatagggatttggccccgagtggagcagccgcctgttaggagcccaacatggcgcctgaaaagcacatgatgcgaaagggaagagaggagaatccattccctgccagccaggcagctgctcactcccgtcagccccattttggggtgggggcggctagataaaacttttattctcctattggagggtctaatttgtcccaaaataggggcaagtggggttgagggtggggtttgggtggggggaggagatcttatccaacctgtaggtggagaactggcccagagggtaacaagtacttgcagtttctctgaaaagttcagtccctcctcctcttccttttctctttttctcccttccctgatagcgaaggagtgtttttctttaccccttgacagaagtggtcctctgccaccttatatttccctgtagtcctcctcttctgtggattcatatgggagcgatatgtcatttaagtaaagttactgttcaacttagttacaatgagttttaatagcgtcccagtgctacattttatttttcaagcttgtactcacggtttagttttttctagttgttagtgattgcaattatcaggatgagcctccttttagcagagtgaacccctttttaaaggccactttaacaacaaccaccaatatattgtttagagacggtttctgtctagtgtaaaacttgagtggtctgactctaataaatggttttgaaatgtgtgactggtattataaaatttgtgaataaaacatataaaatatg

SEQ ID NO: 364439 - DNA, 249 bp, Homo sapiens
cttcgagatcagttttcatttaagtctgcctggattggatggcaggtcaagctttttaaactttaacccaacatagattctgtcagaagcaccactaggtctggtgaatttctggatctattctgtattgcctcctaatcccttggggtatgaatctctgagaagccctttcaccttcagccctggcctctacctcccacatgttgtgggaagtcagggacccctaacagagggaccggctagagccga

SEQ ID NO: 364440 - DNA, 5176 bp, Homo sapiens
aggggcggagcgtggctcggtgacgtcctcccaagatggcggagacagagtgaagaaactgtgttccccccttgggttgctatcggtggtagaagtgttgccattcaccgtcacttattgatgtgtccaaaggattgtgttagttgatcaagatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggtgatctgcccacctcagcctcccaaagtgctgggattataggcatgagccactgcgcccaaccatgaactactatcttaaacatttcctgatgttctacctttgggaagcagtttaaaatgat

SEQ ID NO: 364441 - DNA, 1979 bp, Homo sapiens
aggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcac

SEQ ID NO: 364442 - DNA, 572 bp, Homo sapiens
aggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacaggtaaagtacacattttattttcagttataaaagctagtcagtagtcttcacagcaaaagtagatttgtattttttccattcattctctgaactcaaattcttcacctatttatgcacacaatgtttgtttttataaagaaatcagtatcactgatttaggatgagcaggcaatatttttcataagcacag

SEQ ID NO: 364443 - DNA, 5025 bp, Homo sapiens
aggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggtgatctgcccacctcagcctcccaaagtgctgggattataggcatgagccactgcgcccaaccatgaactactatcttaaacatttcctgatgttctacctttgggaagcagtttaaaatgat

SEQ ID NO: 364444 - DNA, 5072 bp, Homo sapiens
actaggctatcgaggccggtgtgatgtgtcccccctgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggtgatctgcccacctcagcctcccaaagtgctgggattataggcatgagccactgcgcccaaccatgaactactatcttaaacatttcctgatgttctacctttgggaagcagtttaaaatgat

SEQ ID NO: 364445 - DNA, 5104 bp, Homo sapiens
aggggcggagcgtggctcggtgacgtcctcccaagatggcggagacagagtgaagaaactgtgttccccccttgggttgctatcggtggtagaagtgttgccattcaccgtcacttattgatgtgtccaaaggattgtgttagttgatcaaggtaaccaaagatagaaaggcactcatcccttcattcttaaccatatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggtgatctgcccacctcagcctcccaaagtgctgggattataggcatgagccactgcgcccaaccatgaactactatcttaaacatttcctgatgttctacctttgggaagcagtttaaaatgat

SEQ ID NO: 364446 - DNA, 425 bp, Homo sapiens
gtgattaaagtgacaatttgaaaccaaatttaaacactataataatttttgccttgtgttcataaacattgatatttttgtcttagctagcagcttttaaaatattgaaatttaaacttctaatttgtttttcaggagaaagaccatttatctgcgaattatgtggaaattcttacacagatattaaaaatttaaagaagcacaaaacaaaagtccattctggtaaatgcttgtgttttgtttgcttgtttgtttgttttaatttggtgctcatattagtgctattccttaaaatgctgagatgagatttacatttaagcagtttaaattagatgtctatttcaaaaactaggtatatacatgtgaggaaagtagcttttttgcagaaacattcactctggatttttcatattgaatctcttatt

SEQ ID NO: 364447 - DNA, 380 bp, Homo sapiens
ctaaatataaattttattgttcctttaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggtaaaaaaccaaatgagttgtttgatcttttagtcttttaatcaccatagtcttatgaatagactattatattagaattcaggacagtagaattgtaattgtggttccaccaaacaatgttaacacgttcaaggaaccacaaggaagccacagtggttgataggaaataagcagggggtggggactactagg

SEQ ID NO: 364448 - DNA, 2095 bp, Homo sapiens
aggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcac

SEQ ID NO: 364449 - DNA, 820 bp, Homo sapiens
aggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaaaaaaaaaaaaaaaaaaaaaaaatgatgttggagggcgccatggcgccccacgaaaaacggttttcagaaacacatatgagtggggagcagcgggggggccccagtgagtgaagagggaacaacgtgacactaggggggtagcctccaagaggagaaagccgggggcgagagatccacgggggcgtgggggagatctacgacaccaattaaaaaagagaggccgcggggggcgaacccaggacgggtgtctgggaaaaacaattccgagagaggaggactagcgcggagagcacgacaacggggggaatcttatcaacagggggagtacccagagggagagcgagacgatatcaaattgagccc

SEQ ID NO: 364450 - DNA, 5046 bp, Homo sapiens
aggggcggagcgtggctcggtgacgtcctcccaagatggcggagacagagtgaagaaactgtgttccccccttgggttgctatcggtggtagaagtgttgccattcaccgtcacttattgatgtgtccaaaggattgtgttagttgatcaagatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttattggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggtgatctgcccacctcagcctcccaaagtgctgggattataggcatgagccactgcgcccaaccatgaactactatcttaaacatttcctgatgttctacctttgggaagcagtttaaaatgat

SEQ ID NO: 364451 - DNA, 830 bp, Homo sapiens
cggcgcgcgggcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagcccaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggaggtgagaagcccactggcctgaagcctgttgtcatcccaggaggctcttgccctgccagcccttccctatcctgcctgcactctccagtctcctccagcctcctctccctctggatgtgagagaaggagaagggtgaaccaagaaggtcctatgacttcagcccatttcagctttgttttctggctgccctatactcctccaaaggctgtcgccttggttctagggctagtcccagca

SEQ ID NO: 364452 - DNA, 1655 bp, Homo sapiens
cggcgcgcgggcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagcccaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacagtggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggcccttta

SEQ ID NO: 364453 - DNA, 476 bp, Homo sapiens
tggcccttgccccgcttgaagcagcccttccactcttgactctctcctgccccactgccctgctctgttgtaggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggcccttta

SEQ ID NO: 364454 - DNA, 2770 bp, Homo sapiens
cggcgcgcgggcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagcccaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccagtgtgtgagcctgggcttgaaatgggaagtgggatgggacccaggggctgagggtgaacaaggccccagtcatggggaagagctggtgatggaagaactcccgcctcaccaacctggttcccccagccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacagtggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggccctttaaaaaaaaaacacaaacaataatacaatctaaacattgttgtttgcgcgggcccttggcgccctcgaagaaagctttctataacacacttcgtgttgtgggcggcgcgcgggggccccctttgtggttatgtggcacacgtgggcccacagagcggtgttccccataaggaacctcggggaccatgacacccaacgggcggtgggggtttcttacccatattaaaaagagcccgggggggcacacccgaggggctttttgtgaccaattctccaagatgggggtctcagaggcaggccaatagcgggggcctcctatccaaccgagggggggcctccacagaggagaacgcgtcgcatatctacaaatatacgccccccccctggggtggggaatgatgagtacgaaggaggcacacagacaagaaagaacaaagagagaacaaagagaacaagaacaagacacaacgcaacaataagcaatgaagaggagacaaagaagatggttagagcgcgtcagagaacgtgataagagggaagatttaagcagtgcaaggaagacagagagcagagaaggaggagaccagggagaataaggcagagaggggatgaaagcggtaagagagcacagaatatataagtagttgagacaggatgcacaagaagcaggagcatatagagagtgatcgcgaacacgaatgaggggaggaagcgaagagcacgagtggcgagcgctgaagcgaatgcaatggtgctagacagcttgagtaatgttatactcgctgaaacctacacaagagacgcaagggaacgagtgcgaagcgtccattaccaagcgaagcagaacggagacggaacgagacggggcgcctgacagagcgagacagcggccacagggcggacgacatacaatgcgcaagcaaactaacaggctgcgcgtaacacgcctggagcgcgtcatgctgtgagtgggcagacggagtgccgtccgc

SEQ ID NO: 364455 - DNA, 3013 bp, Homo sapiens
cggcgcgcgggcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagcccaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatgtgagtgaagctggcagtgcctagggctgggacatgcagcccagtcctgggacagagagatggtacttctctagctctcatacctggggatgaggtgtgggggcaagatcttataaggaagcaatgggcaaggcttatccattgtataccaaacaccatgccaagtgacagacacaggcttgattcagacatacccctgggaccctcagtcttatctgctgtgatctcatctatcttgctcagctccatgccgaatacaatcgacagaaggacatctacctagcacatcgtgtggcccaagcttgggaattggcccagttcatccagtgtgtgagcctgggcttgaaatgggaagtgggatgggacccaggggctgagggtgaacaaggccccagtcatggggaagagctggtgatggaagaactcccgcctcaccaacctggttcccccagccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacagtggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggccctttaaaaaaaaaacacaaacaataatacaatctaaacattgttgtttgcgcgggcccttggcgccctcgaagaaagctttctataacacacttcgtgttgtgggcggcgcgcgggggccccctttgtggttatgtggcacacgtgggcccacagagcggtgttccccataaggaacctcggggaccatgacacccaacgggcggtgggggtttcttacccatattaaaaagagcccgggggggcacacccgaggggctttttgtgaccaattctccaagatgggggtctcagaggcaggccaatagcgggggcctcctatccaaccgagggggggcctccacagaggagaacgcgtcgcatatctacaaatatacgccccccccctggggtggggaatgatgagtacgaaggaggcacacagacaagaaagaacaaagagagaacaaagagaacaagaacaagacacaacgcaacaataagcaatgaagaggagacaaagaagatggttagagcgcgtcagagaacgtgataagagggaagatttaagcagtgcaaggaagacagagagcagagaaggaggagaccagggagaataaggcagagaggggatgaaagcggtaagagagcacagaatatataagtagttgagacaggatgcacaagaagcaggagcatatagagagtgatcgcgaacacgaatgaggggaggaagcgaagagcacgagtggcgagcgctgaagcgaatgcaatggtgctagacagcttgagtaatgttatactcgctgaaacctacacaagagacgcaagggaacgagtgcgaagcgtccattaccaagcgaagcagaacggagacggaacgagacggggcgcctgacagagcgagacagcggccacagggcggacgacatacaatgcgcaagcaaactaacaggctgcgcgtaacacgcctggagcgcgtcatgctgtgagtgggcagacggagtgccgtccgc

SEQ ID NO: 364456 - DNA, 466 bp, Homo sapiens
ggcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagcccaacttctccctgcgactgcggatcttcaacctcaactgctggtgagtgcgtctgcggagtgcggtctgggggccaccttccgttcgcacccatgcag

SEQ ID NO: 364457 - DNA, 2644 bp, Homo sapiens
cggcgcgcgggcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagcccaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacagtggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggccctttaaaaaaaaaacacaaacaataatacaatctaaacattgttgtttgcgcgggcccttggcgccctcgaagaaagctttctataacacacttcgtgttgtgggcggcgcgcgggggccccctttgtggttatgtggcacacgtgggcccacagagcggtgttccccataaggaacctcggggaccatgacacccaacgggcggtgggggtttcttacccatattaaaaagagcccgggggggcacacccgaggggctttttgtgaccaattctccaagatgggggtctcagaggcaggccaatagcgggggcctcctatccaaccgagggggggcctccacagaggagaacgcgtcgcatatctacaaatatacgccccccccctggggtggggaatgatgagtacgaaggaggcacacagacaagaaagaacaaagagagaacaaagagaacaagaacaagacacaacgcaacaataagcaatgaagaggagacaaagaagatggttagagcgcgtcagagaacgtgataagagggaagatttaagcagtgcaaggaagacagagagcagagaaggaggagaccagggagaataaggcagagaggggatgaaagcggtaagagagcacagaatatataagtagttgagacaggatgcacaagaagcaggagcatatagagagtgatcgcgaacacgaatgaggggaggaagcgaagagcacgagtggcgagcgctgaagcgaatgcaatggtgctagacagcttgagtaatgttatactcgctgaaacctacacaagagacgcaagggaacgagtgcgaagcgtccattaccaagcgaagcagaacggagacggaacgagacggggcgcctgacagagcgagacagcggccacagggcggacgacatacaatgcgcaagcaaactaacaggctgcgcgtaacacgcctggagcgcgtcatgctgtgagtgggcagacggagtgccgtccgc

SEQ ID NO: 364458 - DNA, 1334 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364459 - DNA, 436 bp, Homo sapiens
agtgtgatgttccccttcctgtgtccatgtgatctcattgttcaattcccacctatgagtgagaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364460 - DNA, 1092 bp, Homo sapiens
ctagaggcaccaaggaggccagaggcaccaaggagggccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364461 - DNA, 1182 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364462 - DNA, 1240 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgccaaaattgagtgtatctt

SEQ ID NO: 364463 - DNA, 1092 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaatggtcacactcatggacatggacacgctcacagtaatacacgtggaagtcatgcacatggaatacaagagcgttctaccaaggagaagcagagctcagaggaaagaagaaaaggacacaagaggggttcagaagaaggcgaggagggagcacagtacccaaagatgggccagtgagaactc

SEQ ID NO: 364464 - DNA, 766 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaacttcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364465 - DNA, 477 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggctgcgaggtagagggttgggggttggtgggctgtcacggagcgactgtcgagatcgcctagtatgttctgtgaacacaaataaaattgatttactgtctgc

SEQ ID NO: 364466 - DNA, 1222 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364467 - DNA, 1250 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgcaaaaaaaataaagttaggaccggccgat

SEQ ID NO: 364468 - DNA, 1169 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgatgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364469 - DNA, 1209 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggacgacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 364470 - DNA, 996 bp, Homo sapiens
tccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaataggagtcaataaagtgattggcttagtgggcgaaatattatgctttgctgttgtggatgttatgggtttggacacgaatgttca

SEQ ID NO: 364471 - DNA, 457 bp, Homo sapiens
gcagaagacaccagtggaaacatgtgaggaagggctgtaactggggcctggaggggttggttcaggcttcctgctcatcagttctgtgtgtatccctagtggctggggcctggcactgagtagatgcttggtagagattcgtagaatgaacagatgaagggatacctacctcaggccagagtggtggcttaaacctgtaatctcagcactttgggaggttgaggcgggtggatcacatgaggccaggagatcgagaccagcctggccgacatggtgaaaccccgcctctaccagaaaaatacaaaagttagccggacgtggtggcacacacctgtaatcccacctactcgggaggctgaggtgggagaatctcttgaacctgggagacagaggttatagtgagctgagatcacactactgcactctagcctgggcgacagagtgagatcctgtctcc

SEQ ID NO: 364472 - DNA, 373 bp, Homo sapiens
tcctctcctgccggacaatgtgctaccgtggggcttttgtcctgggctgcagtgtggtcctctcgatcctagaaaagaggccgctcaggatggggatgagacttccattgctccgggcccgatgcatcccctcacgttatcgaggcctgcacagacccaaagtggaaccgccgcgaagacgatggacagctggccgcaggacccagggagagacgcagaaagaggctcaccaaagaccggtcgacataaaagacatccctttttgacgcacagggcacattcgtcaaaagacacacacacacacacacaaacacacacacacacacacacagagggaaagaagcacacagagggtgagagacagagagagaag

SEQ ID NO: 364473 - DNA, 2532 bp, Homo sapiens
tccgggcctggcctgtacggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactaccgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatgcgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatgaaaaaaaaaaaaaaaaaaaaaaaaaaggtttgtgttctcgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364474 - DNA, 635 bp, Homo sapiens
gggaacctgggctctcaggcagatgggattgggtacttttgctacttgctgaataactcttggccagtgactttatgtctggacctcagtttattcatgtgaaaaatggacatgatagcaatagtcattagatggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364475 - DNA, 525 bp, Homo sapiens
cggacgcgtgggtcgacccacgcggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364476 - DNA, 1155 bp, Homo sapiens
gcgggggccggtgcaaaccttacggctaggtacgaggctgggtggccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364477 - DNA, 1123 bp, Homo sapiens
acggctaggtcgggctggtgtgaatcggccgaggaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364478 - DNA, 1287 bp, Homo sapiens
  misc_feature (1209)..(1209): n is a, c, g, or t
  misc_feature (1217)..(1219): n is a, c, g, or t
  misc_feature (1232)..(1232): n is a, c, g, or t
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaaaaaaaaaaaaaaaaaaaaanggggtatnnngggggggaaaagngtaaaagggagggtaagttttgacccatttgtaaggggaaagggggccaaagagt

SEQ ID NO: 364479 - DNA, 1518 bp, Homo sapiens
  misc_feature (1191)..(1191): n is a, c, g, or t
  misc_feature (1204)..(1204): n is a, c, g, or t
  misc_feature (1210)..(1210): n is a, c, g, or t
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaacngaacaacacgaanaacaanaaaaaacaacacgcccgcagaacacctgcacagggcgcacagacaaagagggacacaacaagggagggagcaggggcacagcagtagtattgccacccagcacacacctctttcgtggagcccgaaggagggtccaacacggcgcgggcccccccaagatgaagagaacgacatacagataacagcacaacgcggcggaaccccgcgctatgacgagcagtcgcacagacacgcagcatagacagagagggagacgatgcagcgcggagggggcaacgaacacgagcacaagaaggaacagagaaaat

SEQ ID NO: 364480 - DNA, 1412 bp, Homo sapiens
  misc_feature (1412)..(1412): n is a, c, g, or t
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaaaaaaaaaagagaaaaagaagaaaaaaaaaaagggggggaataaaaggcgggggggggaaaaaggggtgtcagtataatgtcgccacgttggctcaaaacgtggtttcttggacccgaatgtctctgtgtcccgagggtcgacacatatgcagggatccccattgagggaggccgtattaagtgcggaatacccgggtacccccggttatacctccgaaacaan

SEQ ID NO: 364481 - DNA, 1170 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgataccatggtaccttcgttgccggatcc

SEQ ID NO: 364482 - DNA, 1117 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364483 - DNA, 1153 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364484 - DNA, 1081 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364485 - DNA, 1006 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364486 - DNA, 1138 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagataagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364487 - DNA, 1125 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364488 - DNA, 1128 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaagggcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364489 - DNA, 1186 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatgggggcacttgtggtttccattaagccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364490 - DNA, 1152 bp, Homo sapiens
gcgggggccggtgcaaaccttacggctaggtacgaggctgggtggccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatgggggcacttgtggtttccattaagccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364491 - DNA, 931 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagacccgaagccacagtagcagtgccagctcagcagcaggaattctcgcgggagcagcaggaattctcgcggg

SEQ ID NO: 364492 - DNA, 862 bp, Homo sapiens
  misc_feature (810)..(810): n is a, c, g, or t
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgtcgaaccaaaatacggtggtcncgctggggtgtgactttgcgttggccgcgaccgaccggttttggtctatgcc

SEQ ID NO: 364493 - DNA, 802 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgaggggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcgggagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364494 - DNA, 1215 bp, Homo sapiens
  misc_feature (970)..(970): n is a, c, g, or t
  misc_feature (977)..(977): n is a, c, g, or t
  misc_feature (986)..(986): n is a, c, g, or t
  misc_feature (990)..(990): n is a, c, g, or t
  misc_feature (996)..(996): n is a, c, g, or t
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaccagganaaatgangcccaggancagngacctngagcatatgaagagaccaggcgggacgtggaatggacaggacacccccagggggaacgactgacgccacggcagccagattggcacacaagtgttgtcagacccgggagccaggggttccacaacagagagcaccgggcaaacacaatgagcgaaaccaacacacacacgcaacacaacgacaaagaaaagggcgcgacacaaccgacacaacagcgcc

SEQ ID NO: 364495 - DNA, 951 bp, Homo sapiens
  misc_feature (586)..(586): n is a, c, g, or t
  misc_feature (615)..(615): n is a, c, g, or t
  misc_feature (631)..(631): n is a, c, g, or t
  misc_feature (650)..(650): n is a, c, g, or t
  misc_feature (658)..(658): n is a, c, g, or t
  misc_feature (673)..(673): n is a, c, g, or t
  misc_feature (679)..(679): n is a, c, g, or t
  misc_feature (683)..(683): n is a, c, g, or t
  misc_feature (700)..(700): n is a, c, g, or t
  misc_feature (716)..(716): n is a, c, g, or t
  misc_feature (729)..(729): n is a, c, g, or t
  misc_feature (740)..(740): n is a, c, g, or t
  misc_feature (750)..(750): n is a, c, g, or t
  misc_feature (762)..(762): n is a, c, g, or t
  misc_feature (778)..(778): n is a, c, g, or t
  misc_feature (791)..(791): n is a, c, g, or t
  misc_feature (802)..(802): n is a, c, g, or t
  misc_feature (823)..(823): n is a, c, g, or t
  misc_feature (843)..(843): n is a, c, g, or t
  misc_feature (860)..(860): n is a, c, g, or t
  misc_feature (863)..(863): n is a, c, g, or t
  misc_feature (947)..(947): n is a, c, g, or t
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctnggtgttggtgttggacacaagatcccacnattcaaaacgctgggnggctaaatggtttcttctnaaccttcngggtgcttgccttcnggtgcnaccnacagtgtctcccccatngtcttctttgacatcngtttgtgtcccgngattggttctnaagtcttatngcgaagtctgangtttctcccccacacngcttcttgtgccngttgaccctcnatttaaacttttgtgccaaanaaagaaggacccaaccatcnatttcccttgttgatcnganggattgctctgaccaccccacacaaaattaccggcattgctccatccgcaaattgtgtgggattgttgatctttttgcttgatngttg

SEQ ID NO: 364496 - DNA, 968 bp, Homo sapiens
atcgcaatggcattcctaatgcttaccgaacggaaaaattggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcacgggaacatgaacgcaggaagcagtgaggttgaagcctttgaagaaccatgcgggtcgtggaggtttaggcaccccccggtgagaacgatcacgccctcggatggaaaagtgtgactggccgttgtttttaaagctccgttaaaaaaaaaaccggctttggggaaaaagagggttttcc

SEQ ID NO: 364497 - DNA, 1189 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364498 - DNA, 1144 bp, Homo sapiens
acggctaggtcgggctggtgtgaatcggccgaggccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364499 - DNA, 1333 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaatcccaaaaaacaacacaacacaccccgcgcggcgcctcactgatcgggggcgccgcgcaaacacgcggcccaccgggcccagggcgcagccggggttccgggacgccaccttctgcccccaccgggtgccactccgccgtcccc

SEQ ID NO: 364500 - DNA, 1292 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtgagcaggggcccagcaatacaccaagacagacatctctgtcccttgcaccccgagtgccatgatcctggggaccctccttcatcacctatcttcctctcacaccaccccccaaggtgaagaactgaagttcagcgctgtcaggattgcgagagatgtgtgttgatactgttgcacgtgtgtttttctattaaaagactcatccgtcaaaa

SEQ ID NO: 364501 - DNA, 1037 bp, Homo sapiens
tgctagtgaggctggtgttaatcggccgaggacgcagcgcacgtcgccgcgcgcctgcgctcttttccacgtgcgaaagccccggactcgtggagttgtgaacgccgcggactccggagccgcacaaaccaggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaa

SEQ ID NO: 364502 - DNA, 1109 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggagtagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatactcttattaaagttcatcggaaaaaagaaaaaaaaatgtgggggggacgaagtttaacttgggggccaagaggaaggaaggtgaagggagggtccacaaaagggggggaaatggtgtcggtgtactgacgcggggaggtaga

SEQ ID NO: 364503 - DNA, 279 bp, Homo sapiens
  misc_feature (13)..(13): n is a, c, g, or t
attaccgggtcgnctactactactaaattcgcggccgctcgaacagatgaaggactttagttgaacttcatattgtaagaactgttaataaaagttgtcaagtaaaaagcgctatatctaaaaagactttatgaacagttattctatcaacttttaaaggttttaaacctgcccagaaatttattatctccaatgctggtgcatgacaaataacaagcttaattagaggaggagacagagggaaacttcagataccaaggtaatttctgggcgtcgacg

SEQ ID NO: 364504 - DNA, 2139 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaaaaaaaacaaccacaaacacacatccacccacacaatcaaactcacccaaaaaaacagcaaaaaagacgttggcgggcccaccgcgaaaagttacacaactttggggggcgccgcccagaatagacaaggtcccgtcaaagaaccacgacaaagggggtccccaaaaaacggggggacgggcaaaccacggggcgacggtaccagcaggtaaacacggg

SEQ ID NO: 364505 - DNA, 2304 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtatattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagtaaaaatgttccaaatgcttctgctccattatagcagtaaagaacgaatatccaatgcaacaggacaattcagag

SEQ ID NO: 364506 - DNA, 2294 bp, Homo sapiens
  misc_feature (1932)..(1932): n is a, c, g, or t
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaaaaaaaaaaaanaaaaaaaaaaaaaaaaaaaaaaaaaaaaaaaaaaaaaaaaaaaaaaaaaaaaaaaaaaaaaaaaaaacataacaaacaacaaaaaaaccaacaccatgaaacaaggaatctgtgacgatccgtagaaaaagagcagaagggccgtgactactattaatatgtcgcgacgaccgcacaacccattcagacccctatcccattaagaaacccgggcactatggtcctactgatacttcatagacctagggagcgctctcaacagcctgccgaaaaatcggctacaagctcgatagagagacacctattagtagtcagaagaaaagcaacaagagtaaatagccaagaaatataaactggtggca

SEQ ID NO: 364507 - DNA, 1884 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364508 - DNA, 1899 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364509 - DNA, 1495 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364510 - DNA, 1051 bp, Homo sapiens
  misc_feature (10)..(10): n is a, c, g, or t
tgccattganaaactatttggaatgaacccaaaagatagcggaaagttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364511 - DNA, 996 bp, Homo sapiens
cccacgcgtccggacccacgcgtccgaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364512 - DNA, 1294 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgctagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364513 - DNA, 1323 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggagtagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364514 - DNA, 890 bp, Homo sapiens
  misc_feature (13)..(13): n is a, c, g, or t
attaccgggtcgnctactactactaaattcgcggccgctcgacaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364515 - DNA, 632 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagctctggcaaggggagctctgccaaggggagctctgccaaggggagctctgccaagggg

SEQ ID NO: 364516 - DNA, 1919 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgta

SEQ ID NO: 364517 - DNA, 1776 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacttttattaacagttcttacaatatgaagttcaactaaagtccttcatctgtcaagttaaaacagcaagcaaaacaaaatttctctagtatata

SEQ ID NO: 364518 - DNA, 1656 bp, Homo sapiens
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacattctagtatataacagcataagcaatggtttgttttctttgtacattcacacacatttagtgtctagatttgaaactttttaattaagggtcgac

SEQ ID NO: 364519 - DNA, 1220 bp, Homo sapiens
  misc_feature (1030)..(1030): n is a, c, g, or t
  misc_feature (1219)..(1219): n is a, c, g, or t
agcggagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaggagatcttntgaaagaaaacgattttgacgtggacacttagaggctaaacccatggtgtgttgttgggccaatttcggctgggggacttttgcggggaagttgtgaaattgacaaggtgaagccggtatattgacgatggctctttgtggaggactgtagccgagaggaattatgttggtgttgcataaaatgacgcna

SEQ ID NO: 364520 - DNA, 1323 bp, Homo sapiens
tcttggtgtactgttgtgtattctaattactgtcttaagttgggatgtttttacttttcatttcataccattttactcataaagtattttaaatatccatatagtaaattcagcatcaccgaagtgattctccaacagagtatgactcgtgcttatagtctcctgctgaagccagagtttagctttccttactgtgcgcatgcatgagacttcagttcttttcaagcttatttgtgctttggacagttgatgcaatgtgattgctttctttgaattttgaacatttagaccttaatgccagtgacttattaatttttttatattcaattagaacccctaagacatcagtgaagggggttgtgcaaaatagacagaagccttcacagagcagagtgcctaacagagtgcctgtttcaggtttgtagaaaataaattcctgaagcccattcaatagaaggaagtgcacaagctgccccataactcaggccatagaagtggaatagattgtctttccttgccaccataattttggcatattcacagtcatcttattagtgttctttggtcttagcattgtatggcagtcaggaagtcttagtaaaagtgtgattccagtcttcatttctataatatttctgtggaaagcaccttgtatttttcattctgaaaaaattgtagaatttgccatgcttaattcagaaaacctttttatttaatgaataaaagataacgatcatctctggtgctaagtctgtgcattgtctgttcagcttggggaagtgtatctgcacataaggggataaactttctccctcagactataagatcacatgtgaatatgccagtgggaggagggcttcatattttgctcagtccaaagcttgagctaaatctctccttatgttcattatttgaggattaagagctaaactaaaaactgtattttaaaattctgtttatggtggcaagaagacaaactcattcttgagcaaattcaaagctcttaaccaaatgctttaatattttttaggtatctttgttaagacactttgattaagctcacttaaaaattatgtgatccatttaaaaatactttccaaatgttgtgctttaactatactgctttctagacatttacaacaaacctaaattaatcaccaggcattgaagattaaacctttaatcaattttaatctttccattaatatacaattaggcaaattttagagctttattactaagtgatttccttcaaattaggagggaacaagctattggtcgtaactttgaaatgatggctgaccttttgtatgtatgtagtga

SEQ ID NO: 364521 - DNA, 5566 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364522 - DNA, 6376 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtttcatttgaaacctacggggaaccaagcactgtcgctgccctccaggaattcatactctactgctaaaaatcgtcatcatcattatcctcttaataagaaaagcagtccccattatttgttgctttctgcgtgttctgcactacgttaattgccctacatgcattagctcattgaattcttacaacattcctttgagacggataccgtgatcatccctcttttacagaggacgaaacaggtgtggggatggtaactggcttgccaagaacttgcagctagtacgcatctgaataagaaatcttcccctttaccgcttttacaagaagtttgcgtctttggcggaactgatgggcaaagaaacactaggttctgcaaaaaaaaagcaggatctgttctgtgttacttttaccactcttttcagtgacatgtctggcagagcacgggtaaggagcagataggaccatgagtctacggggtttgcaaagaggctcatttgcacaagggtcagtggttctctgtggtataaatggagaagacggcatgtctgaacctgctgtagctgacaaattattactggaagtggaccagtgatgcctgatggcaagatatagagcagtagatttgtggctggggtagccttgtagtcagggctcccttaaaataaaaccttgctgacagtggtaattgtagtgtgaaaggcatagtgtcctcttgcttaatcatgggatacagactgctcacttcttaaatggttacctttgcagtttaagaggtaccagtttctctgggactagagccatggtgaaatttccattctctaaattccactcttccttgctagcttcggtgtatagtccgccttctttttttcttctggtttacattattgtttgagcttattattattcttattcatttattcaatacttttatcaagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364523 - DNA, 5508 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364524 - DNA, 5423 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364525 - DNA, 2802 bp, Homo sapiens
aggctcttccaaaaggctgtttactgagagttgggtcacgccactagttgatgatccccagaggtagaaggtgcttcgttgcggaaacaaagctatatggcatggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaagggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364526 - DNA, 2358 bp, Homo sapiens
tacctcaggatgattcatataaggattaaatatgataatgtatattgcctagctcagtgtttgttccagagtaaaaactcattaaatggtatcattatagaaaacctcccattgagaagtaatactggttttgctctatttttaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364527 - DNA, 4259 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggtttgtagaaaataaattcctgaagcccattcaatagaaggaagtgcacaagctgccccataactcaggccatagaagtggaatagattgtctttccttgccaccataattttggcatattcacagtcatcttattagtgttctttggtcttagcattgtatggcagtcaggaagtcttagtaaaagtgtgattccagtcttcatttctataatatttctgtggaaagcaccttgtatttttcattctgaaaaaattgtagaatttgccatgcttaattcagaaaacctttttatttaatgaataaaagataacgatcatctctggtgctaagtctgtgcattgtctgttcagcttggggaagtgtatctgcacataaggggataaactttctccctcagactataagatcacatgtgaatatgccagtgggaggagggcttcatattttgctcagtccaaagcttgagctaaatctctccttatgttcattatttgaggattaagagctaaactaaaaactgtattttaaaattctgtttatggtggcaagaagacaaactcattcttgagcaaattcaaagctcttaaccaaatgctttaatattttttaggtatctttgttaagacactttgattaagctcacttaaaaattatgtgatccatttaaaaatactttccaaatgttgtgctttaactatactgctttctagacatttacaacaaacctaaattaatcaccaggcattgaagattaaacctttaatcaattttaatctttccattaatatacaattaggcaaattttagagctttattactaagtgatttccttcaaattaggagggaacaagctattggtcgtaactttgaaatgatggctgaccttttgtatgtatgtagtga

SEQ ID NO: 364528 - DNA, 2145 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtttcatttgaaacctacggggaaccaagcactgtcgctgccctccaggaattcatactctactgctaaaaatcgtcatcatcattatcctcttaataagaaaagcagtccccattatttgttgctttctgcgtgttctgcactacgttaattgccctacatgcattagctcattgaattcttacaacattcctttgagacggataccgtgatcatccctcttttacagaggacgaaacaggtgtggggatggtaactggcttgccaagaacttgcagctagtacgcatctgaataagaaatcttcccctttaccgcttttacaagaagtttgcgtctttggcggaactgatgggcaaagaaacactaggttctgcaaaaaaaaagcaggatctgttctgtgttacttttaccactcttttcagtgacatgtctggcagagcacgggtaaggagcagataggaccatgagtctacggggtttgcaaagaggctcatttgcacaagggtcagtggttctctgtggtataaatggagaagacggcatgtctgaacctgctgtagctgacaaattattactggaagtggaccagtgatgcctgatggcaagatatagagcagtagatttgtggctggggtagccttgtagtcagggctcccttaaaataaaaccttgctgacagtggtaattgtagtgtgaaaggcatagtgtcctcttgcttaatcatgggatacagactgctcacttcttaaatggttacctttgcagtttaagaggtaccagtttctctgggactagagccatggtgaaatttccattctctaaattccactcttccttgctagcttcggtgtatagtccgccttctttttttcttctggtttacattattgtttgagcttattattattcttattcatttattcaatacttttatcaagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtggtaagtgctatgaaaattgggaaacagcagggtaatgtgatagtgatagaggcagagttcatttagatggggtcatcagggatgccttctctgaggaggggatatccaagccgagactgaagaataagaaggatccagtcatgctctaaggatcatctagtaatttgtataatctccatattagcactcatatttgaatgagtaatgcgttgtcatatgctgtgttgtgctgtaataataatatagtactatacatctgcaagatataggacatatatgtactatttaagggatgtgaataactttctgaaacaatgaggcatagctctatgatgttgaaagaaaaataaaactatggccataaaagtattatatttccttaataatttccctcacttctaaaattgaatttcatgctttgcttgagtatccatagaagatatattactttatttgtataatctatttacattctgtgtattgctgaatgcatggcatgattaaaaaaataaaatatttgagcagaaatggggttaagaaataatgtgagttgaaacctagacctaaaaaaaggctatgccttaaggtgttttattgtttttacttttgcttttttaaaataaataaaagcttgtaaaatagtctcactcacactgtagagaaccatttgtttgtcattagattcctactttgcatagattgaacacaaataattacaattgattgaatagtagaaacagttggtatgattaacttattgaaaaatacatatattcatttttaaacggaatatatggacatttttcccattccaggcaaaatggcgcgggcacaaatcgaggaccggtctctgg

SEQ ID NO: 364529 - DNA, 359 bp, Homo sapiens
gggtaaacttaatgatacatgtccatctatctatttatcttttcttaagagctatattatcttagactgtataaatgaacaccaataaacattgtgtctgtcttctttctcctaggtttttagtctggaaatacaagcaaaatttaacaaaataactgcagtggcaaaaggatttcttactcgtagacttatgcagacagataagctgaagcaacttcgacaaactgtaaaagtaagattcctgtaaatcgtttgtatttcacttctgtcttagtttctatcagtcttgtgacagctgagctaacagattagttcagaacttaaacgctttttagtcactgtaatctaggcagttttag

SEQ ID NO: 364530 - DNA, 5480 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaagggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364531 - DNA, 5602 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaaaaaaaagtcgacgcggccgcgaatttagtagtagta

SEQ ID NO: 364532 - DNA, 3646 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 364533 - DNA, 3892 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaaaacaaaaaacaaaaacacaattttgtgcgcgcgcgcgcctctcggcgccctctcgaaagaagctctttctctaaacaccatctccgttttggcgcgcgcgcgcgggcgccccaaatggggcgaaaggtacacactgggggcccaaacaccgcgtggtccccccagagggagaacacccgggggccacagaagaacatcaggggcggtgaggagtctctctcccccacaatttaacaaaaaccgccccccggggggggacacccccgagagcgcgactctcgagagcacacaatctcccccaagagagggcgagtccctctagagggggggccaacataacacggggggagatctctatttaccaagccggagggaagctcccacaacagcgaagaaaccccccgagcaaaataataaaaatataatgacccaccggacagacggggcggagtccacccgcaaacagacaagccaagaacgaaaaccacagacacgaagaaccgaaaaaccccaacacactagcacacgagtcagcagttgataagcaacgaagagcaaaccagccaaccacggtagggagagaagaaacatagccagagcaggacagaacagcaaggggagcccaagaccgaggtacgatagaaagtcaagaaagcaaggatcaataagaaaatacaggagaataggacagacacaaaataccgccgcacaacaaaagcgaaaaaacacaacaacacaaaccagtaa

SEQ ID NO: 364534 - DNA, 3086 bp, Homo sapiens
agtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatgaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcaccaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagtaagattcctgtaaatcgtttgtatttcacttctgtcttagtttctatcagtcttgtgacagctgagctaacagattagttcagaacttaaacgctttttagtcactgtaatctaggcagttttagaagtctgattgtttgttgcgggaagtcagggaccccgaatggagggaccagctggagccgcagcaaaggaatataaattgtgaagatttcattttaatatggacatat

SEQ ID NO: 364535 - DNA, 1940 bp, Homo sapiens
gtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaaatagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcatagggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaacccacttttggtc

SEQ ID NO: 364536 - DNA, 528 bp, Homo sapiens
ttctgaaaacagaaacaaaaacaaaacaataaaaagaaaaagaaaaaaaaatccatcccatcaggaagggcaagtgggaactcaggcacaagctgaagctgatgtccacaggtggaatttcttcatccgaaaagtctctgatctgctttttaaaacattcagctgattgaatgagacccacctagaacaagcaggatcacctctcccacttacagtcagctgattatggattttcatcacatccagaaaatacctccactgggccgggtacggtggctcacgcctgtaatcccagcactctgggaggccgaggcaggtgaatcacctggggtcaggagttcgagaccagcctgtccaacgtggtgaaaccccgtctctactaaaaatacaaaaaagccggcgtgttggtggacgcctgtaattccagctactcgggaggctcagtcaggagaatctcttgaacccgggaggcagagcttgcagtgagctgagattgcaccattacactccagcctgggcaacaagagc

SEQ ID NO: 364537 - DNA, 1283 bp, Homo sapiens
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgccaaaaaaaaaaaagactcggactaattctctcatcgagagttccctgggcccggcaggtattggcggggatcgaagccaccggggtcccgggtcccagtacttgagcatagaagaaccgatatcggataaaagtatgacaccgttctttgagggacaagggttgtgtcttacccgaggggaggctcaaaaggttgggaaatcacatgtaaacacccgggtgcctggttgtcaactctgggggcacacgttgcgttatcgcttggaagaccaattgtggttaaac

SEQ ID NO: 364538 - DNA, 695 bp, Homo sapiens
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgc

SEQ ID NO: 364539 - DNA, 3870 bp, Homo sapiens
  misc_feature (3423)..(3423): n is a, c, g, or t
  misc_feature (3818)..(3819): n is a, c, g, or t
  misc_feature (3853)..(3853): n is a, c, g, or t
  misc_feature (3855)..(3858): n is a, c, g, or t
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgataggattttcttagggaaacctgagaaagagttgagactaaaggtatgtgtcatatttttcacaaggcaaaactgggggaatgacatatacagaggcttgggctagaaaaaagataccgttagtccacttacttttgagacagttttggctgctttccctcttcagtgccctgttttagaactgagtccttactgaggcttgtaagatggctattatgggaggtgagagtgttacaaaatgaggctgaagaggtaggtaaagaagccagaccacttcaggctccctctggctttattaaagcaagataaatccatggtggaaaatcagatttgcaagaaaaggtagttgaactaggttgcttattgttgtctagacaagagaccagcttggactagtaaaattagtgaaataagatcgtttatagttggatgacagagccaactagacgtggtaatagtggaggtgtccataactgctaggtgtccagcttgcacactgatgagcataatgaccctagattcagctggggagcagcatttaaacagctgaatttttaaattacctttgagaaacccaaatggtctttttgcagtagcacattactcagtagtctaaactacagaaataaaccttaaggccatgggtataaatgagatctgctggtggtagaggaagagggcctagggtctgaagtttgagaaactccactaattaatggcaaggtaaagcatgataagccagaaaggatggtcagtggtaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagtagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaacgcaagaacactttagaaattaacaacacttaaagctttttacatcatttgtaaataactggtggaacttaacaccacaaaataaagtattataaagaactttatatgaataaaaatatatgcagtctgaaagtgatgcctcagtccttttgcatctgggcactagttgagaaccagcccagccctgggaagacgtcctcccacttgtactattgcacagcaggctagctgcagttcagaattccagaatgttcatcagatgcatctggtcttggttgtggtggacacagacacaagatagaaatgaatgattgctatcctgttccagaaatgaaaatgtggtatcaagtgaatttttacaaaatacttattcttccagttaaaacaaaaaggtccttcagcacaactgtgctgtagttaaaccatggcctataatcccagcactttgggaggctgaggcaggcggatcacttgaggtcaggagttcgagaccagcctccaacatggcaaagccctgtctctactaaaaatacaaaaagaattagccgggtgttgtggtgcacgcctgtaatcccagctgctcggnagcctgagacaggagaatcgcttaacccagtaagtggaggctgcggtgagctgacacggtgccgctgcactccagcctgggcgacagagtgataacatctcaaaaaaaaaaaaaaaagaagcaaaagataatgtattttctcatgctgaagaaatacttgcaggtctgagatttgaattaagatacctatttcacagtttcaaaagtaccagtggcgcacacaaccttcccacccctacccttgacccttcatcaggatcaagtctctgtcttgaggcgggaagcttgtatagtttttattgtttttgctgtgtgttttccagccaggttgtttgtagatgtctgaggtttttcttccatcaggctatctttagacccattgttttccctgaagnntttttttgttttttttgtccaaccacacaacacncnnnnaatatttacttt

SEQ ID NO: 364540 - DNA, 3345 bp, Homo sapiens
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgataggattttcttagggaaacctgagaaagagttgagactaaaggtatgtgtcatatttttcacaaggcaaaactgggggaatgacatatacagaggcttgggctagaaaaaagataccgttagtccacttacttttgagacagttttggctgctttccctcttcagtgccctgttttagaactgagtccttactgaggcttgtaagatggctattatgggaggtgagagtgttacaaaatgaggctgaagaggtaggtaaagaagccagaccacttcaggctccctctggctttattaaagcaagataaatccatggtggaaaatcagatttgcaagaaaaggtagttgaactaggttgcttattgttgtctagacaagagaccagcttggactagtaaaattagtgaaataagatcgtttatagttggatgacagagccaactagacgtggtaatagtggaggtgtccataactgctaggtgtccagcttgcacactgatgagcataatgaccctagattcagctggggagcagcatttaaacagctgaatttttaaattacctttgagaaacccaaatggtctttttgcagtagcacattactcagtagtctaaactacagaaataaaccttaaggccatgggtataaatgagatctgctggtggtagaggaagagggcctagggtctgaagtttgagaaactccactaattaatggcaaggtaaagcatgataagccagaaaggatggtcagtggtaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagtagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaacgcaagaacactttagaaattaacaacacttaaagctttttacatcatttgtaaataactggtggaacttaacaccacaaaataaagtattataaagaactttatatgaataaaaatatatgcagtctgaaagtgatgcctcagtccttttgcatctgggcactagttgagaaccagcccagccctgggaagacgtcctcccacttgtactattgcacagcaggctagctgcagttcagaattccagaatgttcatcagatgcatctggtcttggttgtggtggacacagacacaagatagaaatgaatgattgctatcctgttccagaaatgaaaatgtggtatcaagtgaatttttacaaaatacttattcttccagttaaaacaaaaaggtccttcagcacaactgtgctgtagttaaaccatggcctataatcccagcactttgggaggctgggattacaggcatgtgccaccacgcccagctaattttgtatttttagtagag

SEQ ID NO: 364541 - DNA, 999 bp, Homo sapiens
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgc

SEQ ID NO: 364542 - DNA, 5102 bp, Homo sapiens
  misc_feature (3423)..(3423): n is a, c, g, or t
  misc_feature (4729)..(4729): n is a, c, g, or t
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgataggattttcttagggaaacctgagaaagagttgagactaaaggtatgtgtcatatttttcacaaggcaaaactgggggaatgacatatacagaggcttgggctagaaaaaagataccgttagtccacttacttttgagacagttttggctgctttccctcttcagtgccctgttttagaactgagtccttactgaggcttgtaagatggctattatgggaggtgagagtgttacaaaatgaggctgaagaggtaggtaaagaagccagaccacttcaggctccctctggctttattaaagcaagataaatccatggtggaaaatcagatttgcaagaaaaggtagttgaactaggttgcttattgttgtctagacaagagaccagcttggactagtaaaattagtgaaataagatcgtttatagttggatgacagagccaactagacgtggtaatagtggaggtgtccataactgctaggtgtccagcttgcacactgatgagcataatgaccctagattcagctggggagcagcatttaaacagctgaatttttaaattacctttgagaaacccaaatggtctttttgcagtagcacattactcagtagtctaaactacagaaataaaccttaaggccatgggtataaatgagatctgctggtggtagaggaagagggcctagggtctgaagtttgagaaactccactaattaatggcaaggtaaagcatgataagccagaaaggatggtcagtggtaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagtagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaacgcaagaacactttagaaattaacaacacttaaagctttttacatcatttgtaaataactggtggaacttaacaccacaaaataaagtattataaagaactttatatgaataaaaatatatgcagtctgaaagtgatgcctcagtccttttgcatctgggcactagttgagaaccagcccagccctgggaagacgtcctcccacttgtactattgcacagcaggctagctgcagttcagaattccagaatgttcatcagatgcatctggtcttggttgtggtggacacagacacaagatagaaatgaatgattgctatcctgttccagaaatgaaaatgtggtatcaagtgaatttttacaaaatacttattcttccagttaaaacaaaaaggtccttcagcacaactgtgctgtagttaaaccatggcctataatcccagcactttgggaggctgaggcaggcggatcacttgaggtcaggagttcgagaccagcctccaacatggcaaagccctgtctctactaaaaatacaaaaagaattagccgggtgttgtggtgcacgcctgtaatcccagctgctcggnagcctgagacaggagaatcgcttaacccagtaagtggaggctgcggtgagctgacacggtgccgctgcactccagcctgggcgacagagtgataacatctcaaaaaaaaaaaaaaaagaagcaaaagataatgtattttctcatgctgaagaaatacttgcaggtctgagatttgaattaagatacctatttcacagtttcaaaagtaccagtggcgcacacaaccttcccacccctacccttgacccttcatcaggatcaagtctctgtcttgaggcgggaagcttgtatagtttttattgtttttgctgtgtgttttccagccaggttgtttgtagatgtctgaggtttttcttccatcaggctatctttagacccatttcttctctaaaataaaatacatttgaaaaatgtagaaagattcagaagaaaacagccaaatgaagtattttaattacatcagaaaccaagctgctcttaaatttaagatactgagttaattcaaaagtttcataataccaaaagctattcaataaatgttccctctaaatagctgtgcaaaataaagtttgtatttaaactttaatatacaaagttagtctgacatttacatgcataacgattttattcatgaatattaggcataattcacccaaatcagtgtcattacttttgttaacaattcccaaaccaggctctcaacctcactcttccaaacaggatagtgatggagacttggaggcaatttataatcccctgattatattttcagtagtcaatgaatggaacaatgtcttgtgagcccctatcacttgtctcatacggagaaacagggcagctcattaccagagcctgggcaccacatccactagtttgtaaaacttaggttttacacatctcccatcatcacgggtggaggctctgagaatgacactaactcacaactactacttcttatgcgaacccctcctcctcttacttccaaggatggtctaacattgtcagtgtatcaggctggcaagcatatttccttccccaaatgtatattcccataaataatgggctataccgtcccaatctattttgagatttgtttgagctaaaaataaataaatccctcttaaaatgcagctacctttaatctgttcctatgactggcttaatttgttttactgacattcaaaaagcactgatggaataattattctgcctatcatgggaagcatgaacccatctatttgggatggaagatttctagatagccagaggtgggaagagaacaccagtgaatgtgagaggagaatanagcagaagaattaccagaaaaaaagtgctaggagaggacctgaaataagtactatgttgtaagtttgtctaggattgaatctgtccactctgcagaccttaagaaattaagttgctattcttccccattcttagcagcctttgcgtgaaaaggcaaggtgaggtgtaaggcaggtcactgccagaactctggtggcattgtggtggaaattagaacttaaagttgtaccttaaaaatgtacctttccagcttccactggtcactccagccccttctccgcttggcagccagatgagtggcttccttttagcacttggaataaaacagtaagatccaaacgcttcccacagcctttaagtccctgtgttatctg

SEQ ID NO: 364543 - DNA, 5477 bp, Homo sapiens
  misc_feature (3798)..(3798): n is a, c, g, or t
  misc_feature (5104)..(5104): n is a, c, g, or t
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggtagggtgatatgtcttaaagcactttgtaatgggaatttttatcaccttttaaattggggttccttctctagtgagttttaatgtcagtggtacattcgtagtgttgctctgtctgtagctattaaggtgagttaataaatgggatagcctccacagcttatttttgggaaggttttgctgatacttcctgagaagcccagggaaataaatacgcatagtactggcattctgcatctctttaagatttgtttttatgtgtagtaattgagttttttaaaagcttgtgaaatcgcaggcatattaccaagttcttgattaaaatgtaatacaaaaatatttgctgtcgaattgagtactttattttttctcttaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgataggattttcttagggaaacctgagaaagagttgagactaaaggtatgtgtcatatttttcacaaggcaaaactgggggaatgacatatacagaggcttgggctagaaaaaagataccgttagtccacttacttttgagacagttttggctgctttccctcttcagtgccctgttttagaactgagtccttactgaggcttgtaagatggctattatgggaggtgagagtgttacaaaatgaggctgaagaggtaggtaaagaagccagaccacttcaggctccctctggctttattaaagcaagataaatccatggtggaaaatcagatttgcaagaaaaggtagttgaactaggttgcttattgttgtctagacaagagaccagcttggactagtaaaattagtgaaataagatcgtttatagttggatgacagagccaactagacgtggtaatagtggaggtgtccataactgctaggtgtccagcttgcacactgatgagcataatgaccctagattcagctggggagcagcatttaaacagctgaatttttaaattacctttgagaaacccaaatggtctttttgcagtagcacattactcagtagtctaaactacagaaataaaccttaaggccatgggtataaatgagatctgctggtggtagaggaagagggcctagggtctgaagtttgagaaactccactaattaatggcaaggtaaagcatgataagccagaaaggatggtcagtggtaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagtagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaacgcaagaacactttagaaattaacaacacttaaagctttttacatcatttgtaaataactggtggaacttaacaccacaaaataaagtattataaagaactttatatgaataaaaatatatgcagtctgaaagtgatgcctcagtccttttgcatctgggcactagttgagaaccagcccagccctgggaagacgtcctcccacttgtactattgcacagcaggctagctgcagttcagaattccagaatgttcatcagatgcatctggtcttggttgtggtggacacagacacaagatagaaatgaatgattgctatcctgttccagaaatgaaaatgtggtatcaagtgaatttttacaaaatacttattcttccagttaaaacaaaaaggtccttcagcacaactgtgctgtagttaaaccatggcctataatcccagcactttgggaggctgaggcaggcggatcacttgaggtcaggagttcgagaccagcctccaacatggcaaagccctgtctctactaaaaatacaaaaagaattagccgggtgttgtggtgcacgcctgtaatcccagctgctcggnagcctgagacaggagaatcgcttaacccagtaagtggaggctgcggtgagctgacacggtgccgctgcactccagcctgggcgacagagtgataacatctcaaaaaaaaaaaaaaaagaagcaaaagataatgtattttctcatgctgaagaaatacttgcaggtctgagatttgaattaagatacctatttcacagtttcaaaagtaccagtggcgcacacaaccttcccacccctacccttgacccttcatcaggatcaagtctctgtcttgaggcgggaagcttgtatagtttttattgtttttgctgtgtgttttccagccaggttgtttgtagatgtctgaggtttttcttccatcaggctatctttagacccatttcttctctaaaataaaatacatttgaaaaatgtagaaagattcagaagaaaacagccaaatgaagtattttaattacatcagaaaccaagctgctcttaaatttaagatactgagttaattcaaaagtttcataataccaaaagctattcaataaatgttccctctaaatagctgtgcaaaataaagtttgtatttaaactttaatatacaaagttagtctgacatttacatgcataacgattttattcatgaatattaggcataattcacccaaatcagtgtcattacttttgttaacaattcccaaaccaggctctcaacctcactcttccaaacaggatagtgatggagacttggaggcaatttataatcccctgattatattttcagtagtcaatgaatggaacaatgtcttgtgagcccctatcacttgtctcatacggagaaacagggcagctcattaccagagcctgggcaccacatccactagtttgtaaaacttaggttttacacatctcccatcatcacgggtggaggctctgagaatgacactaactcacaactactacttcttatgcgaacccctcctcctcttacttccaaggatggtctaacattgtcagtgtatcaggctggcaagcatatttccttccccaaatgtatattcccataaataatgggctataccgtcccaatctattttgagatttgtttgagctaaaaataaataaatccctcttaaaatgcagctacctttaatctgttcctatgactggcttaatttgttttactgacattcaaaaagcactgatggaataattattctgcctatcatgggaagcatgaacccatctatttgggatggaagatttctagatagccagaggtgggaagagaacaccagtgaatgtgagaggagaatanagcagaagaattaccagaaaaaaagtgctaggagaggacctgaaataagtactatgttgtaagtttgtctaggattgaatctgtccactctgcagaccttaagaaattaagttgctattcttccccattcttagcagcctttgcgtgaaaaggcaaggtgaggtgtaaggcaggtcactgccagaactctggtggcattgtggtggaaattagaacttaaagttgtaccttaaaaatgtacctttccagcttccactggtcactccagccccttctccgcttggcagccagatgagtggcttccttttagcacttggaataaaacagtaagatccaaacgcttcccacagcctttaagtccctgtgttatctg

SEQ ID NO: 364544 - DNA, 530 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccggggtgagtgtcccttggtgtctctgggctgtggagccgaggctgtgtccggtgttggcgcggggcgtccgggagaggaaggggctgttcttaggcgtgggggcgccggggctggggccaagccgccgcgggaggcgctggggcgccgggcggggaggggccagtcgtccgtctggggctgaggcgcggcggcgccggactggccggtctcccgct

SEQ ID NO: 364545 - DNA, 8544 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgtttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 364546 - DNA, 8270 bp, Homo sapiens
aggcctgaggactgctactcccaggggaagttagattgtccggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgtttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 364547 - DNA, 7125 bp, Homo sapiens
ctattgtttacccatcccaccaagtcttggtgattttcatgagattttatttatctccttgagttcttttttgctattgtgacttttaaatatcgtgcctagcacactaatgttcaataagtaatatttatgattaatctcaagaagtatttgccttctcttttaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgtttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 364548 - DNA, 3699 bp, Homo sapiens
  misc_feature (2886)..(2886): n is a, c, g, or t
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcagtaagtgtttttctccatgtattcctttcatgaaaagaaaaatgccaggtgtatgtttttattcattgtaaataatttctgctactaatagagtattgtgaagctgtaattctgtgaggacagagacagatgtctattgtgtacgatgttgtatctcctgtgtcttccacataatacagttaaaatgttcagtgaatgagagttgagtgggtaaataggtcttactcatgcaagagcattatttctagcagagttaattctgtcatttaagtgtagatcaagtagacccttattcaaaaagggaaaggtagaaattacctttgaagagtcttcaagaacagcagtgaatcagagagtagtggagtggagggattggttgaatagaaaaagaatggatggacctgaaaattaatagagctcatcttgttactttcataattttttaaacagtgaattttttaaaaattaatataattggctgggcgcggtggctcactcctgtaatcccagcactttgggacgccaaggcaggtggatcacctgaggtcaggagtttgagaccagcctggccaacatggtagaaccccatctctactaaacatacaaaaattagccaggcgtggtggtgcatgcctataatcccagctactcgggaggctgaggcaggggaattgcttgaactggggaggtggaggttgcagtgagccgagatcgagccattgcactccagcctgggtgacagagcgagactccatctcaaaaaaaaaaaaattaatagaattgcttgaattcatggatgggaaaaataaatattataaatattagttcttcacacattgacttataaacttaatntaatgcttataaacatcataatatgttttttctaactgcacaggaacattataaaacattataaaagtcttctggaaaaaaaacaaaacataataataaacgaactatcacaagtcaatgtggtgctagattaactgattagcagaagaagaaatttattgaaagttaaaccatcgtttcactggcacacaaaattaatccttgttagactgaagaattaaatactaaatggaaacatggaagaactagaagaaaacaatattgttttcaagaagtatttatgggctactctgggcatactgcctatggggtagccctgctccacaaggagcagtaataaaaataaataaaaacaaaacttaaaaaaagaaatatttgtggattctgattagaaaaaaaaattcaccctcactaattacacacacaccagagaaagcaaaatgaaacagttaccattttttcacctgttaaggtagtagttatagtaccactacacaacagaatattttgctcccctgaacagttgttataaagactgtatagtggccgggcgtggtggctcacacctataatcccagcactttgggaggccaaggcaggtggatcacctgaggtcaggagttcaagaccagcctggccgacatggcaaaaccctgtctctactaaaaatacaaaaattagccaggcatggtggtgcatgccgttaatcccagctgctcgagaggctgaggcacaagaattgcttgaacccagaggcaagtcaagaatgtgtcactgcactccagccttggtgacagagcaagactctgtatc

SEQ ID NO: 364549 - DNA, 2664 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaagaggagactacagtcatcaggcctgcctgtgcagcagagctttcaaacagctgcttactgcctcaatcttaaatatgaaaacccatccaaggataactggacatttgaggaaagcttccaaattgagacagagatcagagcaaaaagaacaaagtcctggaggaagcagacaatgaagggagcagaagaaaacttcagtagaatcaaaatatccttatataaaagaactttttatggaatcagtgagacataagcaggatgctattaaagtaaaaacaggagcttttagaaataagatagcagaaatgaaagatataatggaagcattgaaaggtacagttgaggaaatctagaaagtaaataatataataaagagatgagtggagacaaataaaactagagtattcatccagggtctaacatctaacaaatagtggctttagaaatatataccagagaaaagtgaagagaagacagtatctaaggagtaatataagaaatatttccaaaactaaaggaatttctatataaaaagtttctttttcagaacactggggaaaaagagacaattttaaaatgttgcagggaggagaaaaattaggttccatgcaaagaaataggaatcagatggtattgagattttcagtagcaacaactgaataccacaatacagtgaagtagtgtcttccaaaagctgatggaaaattattttaaacacaaaatcctatatttagccaaacagtcaatcaagtgtaaggctaaataaaggcatttttcagtcatacctcgaaaaactgcctgtgtagggatatttcccctgcttccccactcaggcagctgctgggaatgtattccaccaaatgacgaagcaaaccaagaacaaagaagtgaaggatctagaaaatgggctccaacacgggaaggaagcaaagggagatcccacgcatcagccacacagtaggtcttgtgggcattcagtctagcccagaccgggagggtgaaagtctccaaggaaagaggtgtctcggaagaaatcaattactttcaatgtttgaacattaaatagcaaatgacaaagca

SEQ ID NO: 364550 - DNA, 8740 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgtttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaaaaaaaaaaagacaacaaacaacagacacaacagtgtcgtgggacggaccagggggcaccagcagaagaaaggatataaaaaaccaaaggatggagacacggcggacccaagatgctgataaggaacaaggtgccaaaagcggcgtcccagagagaatacggggcagagacaagggacggggatctcacgcaaaaaa

SEQ ID NO: 364551 - DNA, 8727 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgtttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaaaaaaaaaaaaaaaaaaaaaaaaaaaaaaaaaaacaaaaaaaaaaaaaaaaaaaaaaacaacaccaaaaaaaaccaccacaaaaaaccaacccaacaccaaccatcccaacaaaacaaaccccccccacaacactaccctctcattccacacccaccaacacaaatcccaataacacacacccg

SEQ ID NO: 364552 - DNA, 8673 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgtttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaaaaaaaaaaaaaaaaaaaaaaaaaaaaaaaaaaacaaaaaaaaaaaaaaaaaaaaaaacaacaccaaaaaaaaccaccacaaaaaaccaacccaacaccaaccatcccaacaaaacaaaccccccccacaacactaccctctcattccacacccaccaacacaaatcccaataacacacacccg

SEQ ID NO: 364553 - DNA, 8354 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgtttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaacattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 364554 - DNA, 5742 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctttttttttcccccccctaagttcagagccagggggtaccgag

SEQ ID NO: 364555 - DNA, 2732 bp, Homo sapiens
gccacgtgaccctgagcgggacgacggcaggggagggcgggggctccggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaagaggagactacagtcatcaggcctgcctgtgcagcagagctttcaaacagctgcttactgcctcaatcttaaatatgaaaacccatccaaggataactggacatttgaggaaagcttccaaattgagacagagatcagagcaaaaagaacaaagtcctggaggaagcagacaatgaagggagcagaagaaaacttcagtagaatcaaaatatccttatataaaagaactttttatggaatcagtgagacataagcaggatgctattaaagtaaaaacaggagcttttagaaataagatagcagaaatgaaagatataatggaagcattgaaaggtacagttgaggaaatctagaaagtaaataatataataaagagatgagtggagacaaataaaactagagtattcatccagggtctaacatctaacaaatagtggctttagaaatatataccagagaaaagtgaagagaagacagtatctaaggagtaatataagaaatatttccaaaactaaaggaatttctatataaaaagtttctttttcagaacactggggaaaaagagacaattttaaaatgttgcagggaggagaaaaattaggttccatgcaaagaaataggaatcagatggtattgagattttcagtagcaacaactgaataccacaatacagtgaagtagtgtcttccaaaagctgatggaaaattattttaaacacaaaatcctatatttagccaaacagtcaatcaagtgtaaggctaaataaaggcatttttcagtcatacctcgaaaaactgcctgtgtagggatatttcccctgcttccccactcaggcagctgctgggaatgtattccaccaaatgacgaagcaaaccaagaacaaagaagtgaaggatctagaaaatgggctccaacacgggaaggaagcaaagggagatcccacgcatcagccacacagtaggtcttgtgggcattcagtctagcccagaccgggagggtgaaagtctccaaggaaagaggtgtctcggaagaaatcaattactttcaatgtttgaacattaaatagcaaatgacaaagcaattttatggctcttgtggtgcatttatgaagaattagcaataagttcttagaaaatgaagcaaatgga

SEQ ID NO: 364556 - DNA, 775 bp, Homo sapiens
  misc_feature (617)..(617): n is a, c, g, or t
tattcgccttctagaacttgtgatccacacatcacccatttatattagtggtaaaattatctgctaaaatctaattgtaagaaaggcttaccttctgtcatcaagtgattgtatcatcctggatcgtcatttccaaggaactagcctttcttttcctaagcgtctgtatgtgttctaaaacttccagtatatatttatagaacttagaaaaaatgttacattattcagagtagcaagtcttactggagtacctatgtttgttttcttggtttttatttttttttaagtttaaaagtagtaattaaacctatattttgtgattgtttcctggtctgtgtttttaaattcctttccttcagttttcctcatgaagatgtttcagatactgaatttgtttagacattgaatgactttgttaaaggcacaattaatcacattggttgtactctgaagacagacttctttaaaaaaaaaataaacaatttaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattcaatggcccgtgttttacacacgttnggattgcaaaaaccttgcgttcccaacttaattggctttggaaaaatccccttttggcaattgccttattccaaaagggccgaaccgatggctttccaacagtgccaaccttaatgcaaaggcaaatggaggcctatattgggattcgcgtttttggc

SEQ ID NO: 364557 - DNA, 4835 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364558 - DNA, 4828 bp, Homo sapiens
gcggggcgcagactgctctggcagccgggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364559 - DNA, 4781 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364560 - DNA, 820 bp, Homo sapiens
  misc_feature (32)..(32): n is a, c, g, or t
ctctctctctctctctctctctctctctctcntcgtgccgaaatcggcacgagaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364561 - DNA, 785 bp, Homo sapiens
  misc_feature (765)..(765): n is a, c, g, or t
  misc_feature (775)..(775): n is a, c, g, or t
gcggggcgcagactgctctggcagccgggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattcatcaccagagtttgactgtgttatatctactctccggcatatatganaatgagatcntctgaatgta

SEQ ID NO: 364562 - DNA, 5118 bp, Homo sapiens
  misc_feature (26)..(26): n is a, c, g, or t
  misc_feature (4960)..(4960): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattcaatggcccgtgttttacacacgttnggattgcaaaaaccttgcgttcccaacttaattggctttggaaaaatccccttttggcaattgccttattccaaaagggccgaaccgatggctttccaacagtgccaaccttaatgcaaaggcaaatggaggcctatattgggattcgcgtttttggc

SEQ ID NO: 364563 - DNA, 4767 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagataattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364564 - DNA, 4519 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacatatgaacatgaacattttccttcaacttatacagagttttgtacatgaaccacatggtcaatagcc

SEQ ID NO: 364565 - DNA, 4699 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364566 - DNA, 3674 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364567 - DNA, 3020 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 364568 - DNA, 843 bp, Homo sapiens
  misc_feature (26)..(26): n is a, c, g, or t
taggctaggtacgaggctgggtggtnaatcggccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtgtcagcatttgcaggtatacaggaacagtcctagtgatgcactatttaatcaaaagacggatggatcttttgttcttgcagctggttttccaagaattgatataaagcgggaagaacagaaaacagcagtcataagtatgctactcaaaatattcttctttttatgtgccaaatcctcacattggaagctgtcccgagcaagacaggtagttggtgattatggccagaatttattctgtgctttgactaaaggcttgctgatcaatatatggttaatgttgaaattggggtgcttttaggactcttcagtggtagagctgtctggttagaaattaatctttaagttgggatgccgaggtgggaggatcaggtgaggccaggagtttgagacccggtctctacaa

SEQ ID NO: 364569 - DNA, 648 bp, Homo sapiens
acggcctaaaaaacccaaaccgtggctcaagtagaagtctcaagcattgtgatccccaagttccggtcccgttcaaggtccagttcatttgcattgccaattaacctgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364570 - DNA, 685 bp, Homo sapiens
agcggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagcgcagttgattcgggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggtactatcgaacatgctcggtcttgctcacgcggttgtacgagtacgcggaccgtactttgccccgttaagtagctgtagactttgaactgtttgctccgttcccccgctatccgacatccgcctcttcgtcggactttatctctccgcggtttgttgtactgcacttccct

SEQ ID NO: 364571 - DNA, 2548 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364572 - DNA, 2452 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccagttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgct

SEQ ID NO: 364573 - DNA, 2904 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaactaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaattttttttgggccccgaatattggcgttcttttgcccaccccccctttatgggagggtgttattcaaatccgggggcggttttttatcagagtggggggggggaaaaacccgggtggccccaaattttactcctgtggagaaactcctctttgtggggggggggaataataaaaaggcgccccccccgccctttttac

SEQ ID NO: 364574 - DNA, 3002 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaagggtatgtactggaaactgtgaaagtctttaaaaatatccggaaaattttactgtgaacttagttttgaggacttaaaatttgaatatgttagaatgcagagattctccagagacaattttgctgcttccctcctcccccccacacctttggcagtgtctggagacaagtttggttgtcacaactggttgagagaggatgctgttggcatgtagtcagtaggggctaggcatcctgctaagcatcccacggtgcatagggaaccccctcaacaatgaattggctcaaagtataacagtgccaaaactttgctcttttaatgctgtgttatccagaaataagactcaatagtagcaatagcaaaagtgaacatagaaacgacttacctagactgctgtgtgcaatgtgtgagactacaggatgtatatactttaaaagtggctgttttccattttagggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364575 - DNA, 1680 bp, Homo sapiens
tacattaatcagctcggtaccgggtggggagtacggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364576 - DNA, 2124 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364577 - DNA, 2438 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaagagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364578 - DNA, 2502 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364579 - DNA, 2494 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctagggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364580 - DNA, 2604 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctaaaaaaaaaacaaaaattgggacagaaatgtgtgggggctcggagaccgcagaggacattttgagacaacccacacgttagggggccgggggccccccatagtacacagcagggcgaaagaagagcccaagaaaattggtgacaaaacggtgggagtccacaacaaaaacgccgcgggaaccgggggaccgacacacacaaggcgtcgaccagcactggcgtacacagaggccaagacaataaaaccccacgcggcgggaaacacaaggaacggcccaacacgcggcagacgacaagcaagagcagaacacacaaacccgacagacagacgagcccaaaacacacaagaccaaccagaacaaactcagttcacagcctcgtgc

SEQ ID NO: 364581 - DNA, 1006 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgct

SEQ ID NO: 364582 - DNA, 2416 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaataaaaatattatgcattacaattcacttacccttattttccaacatctgacctg

SEQ ID NO: 364583 - DNA, 2204 bp, Homo sapiens
  misc_feature (2139)..(2140): n is a, c, g, or t
  misc_feature (2143)..(2143): n is a, c, g, or t
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgtatccnnacncataaagacaaataatgcatgacctcactgatctgtggaatctaaaaaaaaatgcaaagaa

SEQ ID NO: 364584 - DNA, 2171 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctattagggtcaagggtgtcctccactctttaacagctgctggacagacacattagagcagctgtttgttattgataataaaatattataaaacta

SEQ ID NO: 364585 - DNA, 1834 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcaccacaaagcacagtcagaagcagtctcgatccgacagagtcctctagtctcgtagccgatcgttcccgtatccaatctacaccgtcaaatagagcttgcct

SEQ ID NO: 364586 - DNA, 1573 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgttttttttttgagatggagtcttgctctgtcgcccaggctggagtgcagtggcgcagtctcggctcactgcaagctccgcctcctgggttcacgctattcttctgtctcagcctcccgagtagctgggactacaggcgcctgccaccacgcccggctaattttttttgtatttttagtagagatggggtttcaccgtgttagccaggatagtctcgatctcctgacctcgtgatccacccgcctgggcctcccaaagtgctgggattacaggcgtgagccaccgcgcccggccaatatatgaa

SEQ ID NO: 364587 - DNA, 1373 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgtcattaaaaaattaaatttgctttagttataaaagagctctgtcaatatacacaaactatatacttcagacattcacaaaaatgtgagcagaaggcttatcaaaagacatttaatacaattagttttcaacaaccccttggtgcttgaaaactaattgtattaaatgtcttttgataagccttctgct

SEQ ID NO: 364588 - DNA, 1040 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggagattgcgccactgcactctagcctgggcgacagagcgagactctgtctcga

SEQ ID NO: 364589 - DNA, 528 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaagtcgagagtacggaagtcgagagtacggaagtcgagagtacggaagtcgagagg

SEQ ID NO: 364590 - DNA, 541 bp, Homo sapiens
ggatatggacggataagagatattgatctgaaaagaggctttggttttgtggtaagtatttagaactgggtgaattatctgctaagtaggtagagttttgataagcagttgttttcgatcttgagtccgggtggaatatttgccttcagaaaatgttacccagccttatgtctgaattttattgaggctgaaaacaactttaacttgccggctcactggaaccccactcccagtggctccttgattaggtttgactgtatggcagtgtcgttaagatactcttcccattctgtctcctgatttcagtgctcttaatgtgttgtagaatactcttctaaagccaatgttaagagtcttatgcttacattttaggaatttgaggatccaagggatgcagatgatgctgtgtatgagcttgatggaaaagaactctgtagtgaaaggtgagattcctgtgtaactagataaccctgggacatagagcagactgggtctgctggcatatttttctaagtagatttatgtagcttaagtgtgtaac

SEQ ID NO: 364591 - DNA, 843 bp, Homo sapiens
agcggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggcggggtgaagttgcctcttaagggggatttaaagatggtattcgaaaaactctcttggaaggaaaaaacaatgccccgaaaaaatgacccttgtggggccgcttggcccaaaaggttttagacttgagcaggttattgatgcgggcgcgaattggggtcccttggccaattcgccttttaggaggggttttaaaaaaaaggggggcgttt

SEQ ID NO: 364592 - DNA, 2221 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgct

SEQ ID NO: 364593 - DNA, 2506 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccagttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgct

SEQ ID NO: 364594 - DNA, 2494 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364595 - DNA, 2820 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaaaaaaaaaaaaaaaaaaaaaaaaaaaaaaaaaaaaaaaaaaaaaggaaaaaaaaaaaaaaaaaaaaaaaaaaaaaaaaaataagataaaaaaaaaaatgcaaggggggccaaaagggccgagtttggcaaaaaaagggcgaaatccaaataaatggccgagtattaaaaccctgttaattgagaaaacattggagttaacaaacttaaaccttttgcaaaaaataacatttgtgcaaactggatgaaaaatgagaaatcccaagcggaacgcctttgcaaaaagttgcgctaaattatgggcaaatggaatcttgtaagaaccaatatgccggtaaattcagcgttaatttttattaaaaaaaaatcattatttcacgaaatgacgtaaatacgaaaagaccctaaagaacc

SEQ ID NO: 364596 - DNA, 3090 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaagggtatgtactggaaactgtgaaagtctttaaaaatatccggaaaattttactgtgaacttagttttgaggacttaaaatttgaatatgttagaatgcagagattctccagagacaattttgctgcttccctcctcccccccacacctttggcagtgtctggagacaagtttggttgtcacaactggttgagagaggatgctgttggcatgtagtcagtaggggctaggcatcctgctaagcatcccacggtgcatagggaaccccctcaacaatgaattggctcaaagtataacagtgccaaaactttgctcttttaatgctgtgttatccagaaataagactcaatagtagcaatagcaaaagtgaacatagaaacgacttacctagactgctgtgtgcaatgtgtgagactacaggatgtatatactttaaaagtggctgttttccattttagggtggttgagtttgcctcttatggtgacttaaagaatgctattgaaaaactttctggaaaggaaataaatgggagaaaaataaaattaattgaaggcagcaaaaggcacaggtatctctaattttttaaagtcaaaagttgtatttaatgggtttgttgtagagtcttatctaggctgatttcttttcatttttcatagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364597 - DNA, 1333 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 364598 - DNA, 2629 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctaaaaaaaaaagaaaaaaaaaaaaaaaaaaaaaaaaaaaaaaaaaaaaaaaaaaaaaaaaaaaaaaaaaaaaaaaaaaaaaaaaaaagtgggggggggggggggcaaaaaagatgcttttaaacaaaacaactcggggtgggggggcggcggcgccacaccagggagaagaaagaaggaagagaggaggacaaagaggcgcttgtaccgaagagaaaagcgcgggcgcaaaaaaaaggggcggggagtccatctccacacagaaaaaaaaaaaagacgccgcgcgggggaacaacaacgcgggttgttgttagaaaaacaacgcgagagggggggtgacgagggtgactctatgggggggttatacaaccagagggaggaaacaggagaaggggaaaaaaaaaaaagcg

SEQ ID NO: 364599 - DNA, 2675 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaagggtatgtactggaaactgtgaaagtctttaaaaatatccggaaaattttactgtgaacttagttttgaggacttaaaatttgaatatgttagaatgcagagattctccagagacaattttgctgcttccctcctcccccccacacctttggcagtgtctggagacaagtttggttgtcacaactggttgagagaggatgctgttggcatgtagtcagtaggggctaggcatcctgctaagcatcccacggtgcatagggaaccccctcaacaatgaattggctcaaagtataacagtgccaaaactttgctcttttaatgctgtgttatccagaaataagactcaatagtagcaatagcaaaagtgaacatagaaacgacttacctagactgctgtgtgcaatgtgtgagactacaggatgtatatactttaaaagtggctgttttccattttagggtggttgagtttgcctcttatggtgacttaaagaatgctattgaaaaactttctggaaaggaaataaatgggagaaaaataaaattaattgaaggcagcaaaaggcacaggtatctctaattttttaaagtcaaaagttgtatttaatgggtttgttgtagagtcttatctaggctgatttcttttcatttttcatagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgccccttgggagtcttgaatttctcatagcaccaaaatatggcaatgaggagaagcccttctccaagctggaaaatcatgtagaggaggggaaagaagaaaagtggtccaatgacttcaggtggaaaggccacattgaggatggtggaacagagttggacattttggcatccagtctccatgctgacagtgcgtctgcacccgtccattgaggcagaagagagcagagagaacataacccagca

SEQ ID NO: 364600 - DNA, 1755 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaatcaatgggaggaccattaattcatttgaagctcagcttaacggatcactaggggtcctctagaac

SEQ ID NO: 364601 - DNA, 1419 bp, Homo sapiens
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtgcctttggctgccttcaagtaattttagtgttctcccatgtagtgcccttccagaaaggttttcaatagcattctttaagtcaccattaagaggcaaactcaaccgaccccttcagataatttagggcggtgtggatccgctacgttactgccccagcttgtctcatggaatcgg

SEQ ID NO: 364602 - DNA, 967 bp, Homo sapiens
  misc_feature (912)..(912): n is a, c, g, or t
cttttggggtctttgctcttttggggtctttgctcttttggggtctttgctcaagaagttgtaagagagattgaaaaccagaaaacagatgcagctagcaaaccgtttgcggaggtacggatactcagttgtggagagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgctttccgataaaaagtccggtcgagagttgaagatacgttaagtggtcggtggaatcctgatcgcagncgttatagggagggctgtgccgaatggctttcatcgtgggtgggggccctctggg

SEQ ID NO: 364603 - DNA, 295 bp, Homo sapiens
ctcactcaaaatgcagtcactctggttttaacgcctctgacacaatgagtgtatgctagcatttaacgtttttgtccttttatatttagcaactcattttcctattaagaagttatagatggaaaaacctctgctagatcaccgtgtccagagtcctttttctgtaaatgtcttatttttgaccattcatgttgtgttttgttgatctcacacaataagaacagaatagccatttcattcaccaagttccagtagtaaaaaacaccttgaaatgtaaatgacctttaaaatatta

SEQ ID NO: 364604 - DNA, 351 bp, Homo sapiens
aagccgagcagtgtggcaggtgcctgtaagtgctagctacctagctactcgggaaactgagaaatcacaggtgggaggatggctgaagcccaggagtttgagttcagcctgggcagcatagcaagacctatctctaaaaaataagtaagtaagtaaataaataaataacaaaacaagcagactaaaaaatcagtaaagatagagaaataagggccaggtgcagtggctcacacctgtaatcccagctactcgggaggcttaggcaggagaatcactcgaacccaggaggtggaggttgcagtgagctgagatggcaccattgcaccctggccgaggcgacaacagcaaaac

SEQ ID NO: 364605 - DNA, 13886 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364606 - DNA, 13986 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaaggtgagcaaggcgaggagtgcgggcggcgccctggcgtgagcctggggctgcgggccgggggtcgggcaaggcctcccccacgtccattctaccctccaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364607 - DNA, 13653 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364608 - DNA, 14119 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacaggtgcttctgatcccaatccctgatccctgttggccctgatcactaatgcttctgaatccattaattcctgccatgactagtctggagttcccagtgtcctgagggtccactgctcctggctgagtccttgttctggacctcaggactcctgagctgttcgtattaggcctcttgcagggtgctgagagcagatcccatagttggggtctaactctctgctctttccataccagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364609 - DNA, 14405 bp, Homo sapiens
cttgcaagttactttgcttttctaatgttggttttcttatctataaaatgcgttataaactactacatggagttgttgtaagggttaaaagacgttaatatataaagcccttagtgcagtgcctgtcacatattaagtgctcggtaaatgttaggtgttgtgatgatgatgacagtgacaactactgctgctagaaagcctagttaacttatcaggttgttgggcatctagaacccagtgaactttaaagagtagagaggataatcaaattagtgatgtttattctttgccatttttcctttcccattctgtgagtggtttggacagatcattcttgaagttctagctttatggaaatcctcaagtcttttatgcagtggaacactattctaatgccacactggtaactgggtaaaagcctagcacctgaaatatatctgttttcatgaaaattgtacgtcgtgatgtatttgggagacataatttgaccgatagtataacaaaatttgttatataccagggtacttaataagggttttctttgtgctgcttttagatataaactaaagactttttaaaaatatttttagagtaaactgttataacattctttccaattctcaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364610 - DNA, 13541 bp, Homo sapiens
gagccatcttctacatagctctctaacaccaacagcaatgaggatagtaccatataaaaagtagcttgttcaagagaaaactgatgcataatgatagaaatcattagtgtttgccttgagtcagggatagcagattgacttggatttggcataaagagacttttgaggggaatggaaatgttctatttcttgatttggatggtggttacattagtatatatgattatcaaaacttaaaatgggtacattccttttattgtatgtaaattatacctcgataaaacatagtttttaaaaagtagcccagaatttcttaaagtgagttatatattttgtgcctaacttcacattgctttactcacttctcaatagttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364611 - DNA, 13016 bp, Homo sapiens
gcacggtggtgcatgcctgtaatcctagctaatcaggaggctgagactggaggagcacttgagctggggagttcaagggtgcagtgagctataattgtgccactgcactccagcctggcaccagagccagaccccatttctttaaaaaatttttttctttttttttttttaaaaggctagccgttgtctgaatattttgttagcgagtatgttaaaggaaggactctttaaatttctgagtactatattacccagttagagctctggggttaattttcattaatgcgagttaatgcatagcaaaacaacttttgttacagtgtgtattttttaaactagtaatcttattgtcatggaagcagctttcactgatacaactactgttacgttgaatagttaatatcagtcattgctaacaggaataatagatttttaaatgatttagttgttctagctgcataatttctttgttaatttgtaatgcttcagaattgttttcatcccttgcatttgttttgcacagaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364612 - DNA, 13290 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364613 - DNA, 13673 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaactatgactagtctgcttcatctagatgcgcccacccctgatcaccaggggacaggctcctgagcctatacagaaggtgatatctgcctccaggattggctctgctccccaatacaactatttgcagaggaaattgggatcctccgcttccatcctgactccttggcaggcacacaggcctctttagtaaggttcacactattcattgatcatggtgttagggcatgacaagaaaatgacaacagttcaagaattcttacaggggtttctagattttcatttcctgcctctcatttccccaccatcccccctttttaaactaagattagaaaatactcattaatatcagccttcctgcccttccccaaggttctcagcaccccc

SEQ ID NO: 364614 - DNA, 9822 bp, Homo sapiens
  misc_feature (9796)..(9797): n is a, c, g, or t
  misc_feature (9799)..(9799): n is a, c, g, or t
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaaggtgagcaaggcgaggagtgcgggcggcgccctggcgtgagcctggggctgcgggccgggggtcgggcaaggcctcccccacgtccattctaccctccaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgaggttagacctgacgaagggagaggaccgcggactgtccaggatgttggagggagggggtcccgggggaggggctctctcaagccaggagagaccgccatcctactaggcagagggaaataccgcctacactaggcaggtggacatctgggatgaaggtcgagagcctgctgatcctccattgatcctgtttgaagggtctctcnncncagttccctccaccccaagatct

SEQ ID NO: 364615 - DNA, 12859 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggagctatgactagtctgcttcatctagatgcgcccacccctgatcaccaggggacaggctcctgagcctatacagaaggtgatatctgcctccaggattggctctgctccccaatacaactatttgcagaggaaattgggatcctccgcttccatcctgactccttggcaggcacacaggcctctttagtaaggttcacactattcattgatcatggtgttagggcatgacaagaaaatgacaacagttcaagaattcttacaggggtttctagattttcatttcctgcctctcatttccccaccatcccccctttttaaactaagattagaaaatactcattaatatcagccttcctgcccttccccaaggttctcagcaccccc

SEQ ID NO: 364616 - DNA, 11771 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacaggtaagtgactcatatgagtgtgggtctagctacgcagactgtcctctttgccatttactgccatgtgtacgtatatgtttgtatctgagtggctgtggctatgtacatttggtaaggatgactcaaacacagagcctggcacagagtaagtgctcaacaaacatttactgcccaaatgaattataaactaggaaacat

SEQ ID NO: 364617 - DNA, 11747 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacaggtgcttctgatcccaatccctgatccctgttggccctgatcactaatgcttctgaatccattaattcctgccatgactagtctggagttcccagtgtcctgagggtccactgctcctggctgagtccttgttctggacctcaggactcctgagctgttcgtattaggcctcttgcagggtgctgagagcagatcccatagttggggtctaactctctgctctttccataccagctgatggctggatccacaaggccgtagtcctgggctctgggatgcacattattgaagagacacaagtgttcagggagtcccagtctgtggaaaatctagtcatctctctattgcgctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364618 - DNA, 10831 bp, Homo sapiens
  misc_feature (10830)..(10830): n is a, c, g, or t
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcgcgagttggggtgctcccggtactcggtgcgggagaagcaagggccaggtgcagatggggtgactgatgacaaggtggtactaaattccttcagcggcagcggtgcccactgacgcgagaggacctgggcaggctgcacagacagagaagcggcaaggacggcaaccgggtggcccagtggatgggaccggaggattggcaagggaaacctcggagaagagacagagagacccggagaagcgagggggcatacacgacggagaacaccggagcacatggcgaaaagacaccacggaaggagcgacng

SEQ ID NO: 364619 - DNA, 10847 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaacatgtgtttggtaatatttgtttgggagttggggaggctaagttatctggaatgccctgttccctcagcccaccccagtcccctggcttttaaacatttcttcttgctttggattgtccagttttttagcttgatgtctcctgtttctggaaaacataaagccaccattgtacacagttcacttttatataacccagttaattgctgtatactttgcaatcaggaattcagtaatctcattcttacctcattcactatgttcattccaccattcattctaacaattgagtctcaactacatactaggcactctttttaggattcagtaaggatttgatggtgaacaacatagagaactcatgaatcttacctcctggtatccaggttaaaatactttctgttcttgggcaaagagaattagaaacaaatacccttaacctgactcccttgttcttgagcccaggaccaagaaagaagaagctgtacaatgcagaagcagggcttgagatcacctccaacctgccaagcagatagagatctgggtatgccaacttgggaggcagaggttgaaacctcataggaggaactttggagctcatagaaggccttggcattgtcagaggccttgagttccaaaaccatgccagtatttctgccttctgacaggctggctagaaagagactaaatgggagcatttttctctgacagtggggcggagggatgaggggatgacagcccaggaagaagcagagacattgccataagtacttactagagggcaggcagcacagctttatgcaagttaagggccttgaccttgccccaaggcctgacctcagatcccagattcatcatactagccttttgatctttgccaaattacttaaactcactgtttcctcatctgttgaataatggtgtctacctcagggtttgtgaggactaagcgagctaatgcatgaaaagtgcctagtacagtgcctggcatatagcaagaactcagcaaatgcttgctgctctaacgaggcgtttctctgatgacagatttgatcttaagcagacacctcagggtgtactgacatctgagcaaaccatatctccaaaaattatagttgtaagtgtgccctatttctttggataccgggagctggagcttctctgtccagctatctctgctgattttttttaattaaaattttcactttttaaaagccagcatgctaaagctgagaaattggtgatgggtggtggttttccagcatttgtgggaatgtcctgacactccctttcccttactaaccattccctaggctggagtcaagagagggcaaaccagaaggcccagctttgggtctgactccaagacgactggctgggaggaaaactaaacaggcttctgaggcacagtggaatagtgagacttccgcattgttgcactggtgacagcccctacagaagaagcacctcagctgtatatatagccaaaataaagaccacaccacctaaagggaaagtgctgggcaaaccagagatggagatggcaaagcaggaacagaaatgctgccacattgaacagtaagcaggacaacttgactaggccagagttctcttgcttcagggaacctgctcaagtttcaggaattcatacccacccccttcacctaggatccctgctacagtaagtaactgttctgtgcaaagtggagctaaactctggtgtgtaagtggctgacaatcactgctgaagacggccagcactaccctcagccactttcttacagcaaagttggggaaaatagactagcaaaaacaaaactcatacttttctgtgtgtgtgaagttctccagaaggtttccaaatggaatcctctcacagccaccctgcgaagcagccagggtagtgaccttatggatgagtgacagcctgttcaaagaatgacctgcctgtgtcccaggatgcagatttatggctgggttagggttaatttctttagttgatttccagttttcttttccactgtctgtcagtattcccccgttcttattttaccagctggatttgcagagagacatactgtcaatcaaaagggcttcctatgggcagctccattaattgcttttacatctgatactctcattaggtttagagattttactgggaggctagcagaaggaaatggattgtggtctgctatcaaaagtactgaagtaactgcccagtgatcattgaaatcacacattttgctcatttaacaatgtctgagtttgccatcagcacctcagaggagcaaagcttggttcataaagtgaagttgagtgatactgagcctaccacactggcctactcgccacctccagagctatctgaagtcagcactgcaggttctgtgaacatttgggaagctgtgcctcttagccccctgggcccctacagtttaattgctctcctatctgctactgaaggaccagcagtcttcctaccctgcctccactgttaccaccaacccactttttgataaggactgcagatttatctttcttagccctgccttgactggtcttcccacctcagacgtccttactcagtccatcatctctttcaggattttcttctgtggtctttttcaaactactagctgacttttcccttttatttcccactaggaacccctccccgcccccccccccccagccatttcatcaaatcaaactcactgccctctttcatgccccttccttagttccccaacacaagcctgtgcataagcttgaacatttctacctttgccaatggtatttccccttctggcttaccctgcttcctccttctcagacttttccagtcttgattgtcctctccataaacacaagaatgaacttcaaggcaagttacttaatgtcttagagcctgtttccccatccataaaatggggctataaattcctcaggatgggatgagggtacaaataaaaaatgaagcaggatattctttgtaaaagtgtgtgtacattttttattgtgtttctccccagctaccttccctctccccgccacacacatcctatttgcagagtgttgggggaggtggaactgtgatgtgggccctgctgtctagcagtctgcagtcacacacagccatccaaactacgagattgtatatgattcagtgccaaactgtgagctttggggaatccagaaagaaggatgaagcctttcccaagtttcctttagttaaatgtgccacttgaatcctgttctgactcctaggcacatgcaagagtcaatcacatatgttcctgtggcctttatcattttggtccatctcttgagcccacatgaatactgtcatggatggaggaggaaggaccaggctgggtcagggcctgaatgcaggttttgtttggactataggggctaagttcactttaataggctgtgacctattaaaggaggcaggaaccaagtttgcacagaaggaccatcctagttgagttaaaggagttggggagttgattgtgaggggtttcctagattgctgctgggtaaggtgattgaatctgggaaggatagggtacttgattgcctagaagggtgcactctaagttctggataagaatggtgcccaagatgagctggaggggaaggcaagtgtttgaatgacccagtccctgaggtgagcctaggttagggttaagatttggtgagtgaacaggtgcaaacgcttgtggcttatttatccagaaaaagcattttctgtgtgcctttcaggtcaggctgttactttatccccttcaggcctgaccccatctcccccacgcatagctcaagctgaacagcccctgaagctgggaatcaagcccctaccttgtgttcagagcttccctaacgtccagtcgccacctagggtagccttccctccacaccctaggccgagagcagaagcgggtggcaggagcacagggagtgaggtccaggttagaggacaggccagaaggccctccgagagggtcccccaaccccgcaacgccaggacaggtttgcacgtccccagcagtaggcaagtcaggggggtcctagggttacagcggaggagaggacgggctataagcatgtggagggtgcacggggtggcgaggccaccaccagggggcgatttcagggccgcagcgcctagaggtggggggtcgcccgatggccgaaggctgtgtgtgagcctcgccctcaaaccgcctctattgtgctagagtagggggcgcaaagaagagagtggcgaccttcccctcaccccacccagtcggccccgcctttcaggaccccgccccacccccggctccgcctccaccacccccccccgccccgcctccagccgcggccccttcctctcgcagctggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattggtgagcaggccttcttccctatcacagacatggtatttttaggatgtggatctcatctctaggacctgccaccatgtatatgtcatgtgccctgttgaatatgacatgtctctcatgcctggaatatccccacgccagatggaggcctctacacagccactaggtatgaattccggagcattcctgacatccgccggagccgccacccacactccctgagaactgaggagacaccaatgcattggctcaatggttaggaggatgaggcacaggatgatggggggtaggggactatttcttcatttttactcccttggccagctgaccaccccacccccaaatccccaggtgagcctgtccattccattcctgtgtgttgtcaagtgaggggtcagcctcagagtgagggaaaggaatccccagcctgtctcaaaagcctct

SEQ ID NO: 364620 - DNA, 4575 bp, Homo sapiens
tctctgtgttgtgctgtctcccccgttttgcccgcccctccccgtagtgatggtcgtctctctccccaaggtgactcccccccggctcgcgtcttgtttcctcgtcagcctgcctcgttctttttttgtgtcgccgcccgcgcccccctcccgtctttttatattggacgcctcccctttcttgagtgggcgccgccctcttctcttacctcaacagtggcggggtgggctgcctcattttgtgtgctcctctcccggcggcaggtagtattttcccccccccccctctctcttcttttttttttttttttttttttttttttttttttttttttttttttttttttttttttttttttttttttttttttttttttttttttttttttgaaggagacggatggtttattaaggggacttccatacagggcactccagtggcggcgggctgcactggagaaccattcccctttgtaaaaaccatgcagtttttatagcattttcacttagcatcctccccctaatcacctccacctggcaaacttcatttaacccaaaacaaagggccttgatcccctggacagcatgtgttccacaggatgggctaggggctcagatgttcttcatagataaggagtgaatctctaggttggccacttgcagatttggaactccaaacatacattgttttgaggccataaggtcattctcaggggatgcttaagttattgctgtcaggtgcatctgccatacaacctgcccctatccctgatcgctgatccctgaccccagactgatctgactttgagccactgtccctgcctgtcttcggaaccacttactgctggttccttgttccctaggatgctgaggccttcaccttgccaaccagcttcgaggaggggaaggagaagtgtccttatgacccagcccgtggcttcacaggcctcatcattggtgagcaggccttcttccctatcacagacatggtatttttaggatgtggatctcatctctaggacctgccaccatgtatatgtcatgtgccctgttgaatatgacatgtctctcatgcctggaatatccccacgccagatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcgcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364621 - DNA, 1086 bp, Homo sapiens
gcacgagggaactcagccgcatcctggaacagcctcccagaacaaatgctcttccaagccagcctatctgtcccaggctgggccactgcctccctaacacagccaccctcccttcattacccccacctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364622 - DNA, 3555 bp, Homo sapiens
cttgcaagttactttgcttttctaatgttggttttcttatctataaaatgcgttataaactactacatggagttgttgtaagggttaaaagacgttaatatataaagcccttagtgcagtgcctgtcacatattaagtgctcggtaaatgttaggtgttgtgatgatgatgacagtgacaactactgctgctagaaagcctagttaacttatcaggttgttgggcatctagaacccagtgaactttaaagagtagagaggataatcaaattagtgatgtttattctttgccatttttcctttcccattctgtgagtggtttggacagatcattcttgaagttctagctttatggaaatcctcaagtcttttatgcagtggaacactattctaatgccacactggtaactgggtaaaagcctagcacctgaaatatatctgttttcatgaaaattgtacgtcgtgatgtatttgggagacataatttgaccgatagtataacaaaatttgttatataccagggtacttaataagggttttctttgtgctgcttttagatataaactaaagactttttaaaaatatttttagagtaaactgttataacattctttccaattctcaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggccaaaaaaaaaaacaaaaaaaaaaaaaaaaaatttgggggcggctttggggaccctcaagaaaaaagtttgttaaggaaccacttcgtttgtggggcgcggggcaccaagttgtgttaaggtcggaacaagtttgggatataaggctggttaccccatgggaaaaacacgtggtgaatggaaatgttggtttggatttccaaccccatataaaaaaacgcccgtgaggtaaaccggacacatcttataaacaaaattccaaacatggaacgttacgaaaggaccatcacgtagatatcattcaacaccggcacccccaggaaactcacaattaaagtttcaccagctaactgggcacctacacccacacgggccgcaacacaccaaccccgcagcaaagaacaagccccacgaccggagagaacgacccgcacacaccgacgacgcacaagccacacggagggaacaagtagcacaaccccgcaccacaacaaagacaggaacggcacagagacagagcgcgacacccccgacgctagacggtatatcaattacgacggcacagcaggcaacaacaagacgcagaccccgaaacagaagcacagaacacaaccagcagacagcgagagcacaaacactaagcagacagaacacaacgaaagaacgcgactaac

SEQ ID NO: 364623 - DNA, 4806 bp, Homo sapiens
caaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttga

SEQ ID NO: 364624 - DNA, 2396 bp, Homo sapiens
ccattttcctcggcatagcagccatagttgccactgtgctcaggctgtgcatctgtaaccagcagcccgtccaaaccccacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacaa

SEQ ID NO: 364625 - DNA, 1398 bp, Homo sapiens
tctctgtgttgtgctgtctcccccgttttgcccgcccctccccgtagtgatggtcgtctctctccccaaggtgactcccccccggctcgcgtcttgtttcctcgtcagcctgcctcgttctttttttgtgtcgccgcccgcgcccccctcccgtctttttatattggacgcctcccctttcttgagtgggcgccgccctcttctcttacctcaacagtggcggggtgggctgcctcattttgtgtgctcctctcccggcggcaggtagtattttcccccccccccctctctcttcttttttttttttttttttttttttttttttttttttttttttttttttttttttttttttttttttttttttttttttttttttttttttttttgaaggagacggatggtttattaaggggacttccatacagggcactccagtggcggcgggctgcactggagaaccattcccctttgtaaaaaccatgcagtttttatagcattttcacttagcatcctccccctaatcacctccacctggcaaacttcatttaacccaaaacaaagggccttgatcccctggacagcatgtgttccacaggatgggctaggggctcagatgttcttcatagataaggagtgaatctctaggttggccacttgcagatttggaactccaaacatacattgttttgaggccataaggtcattctcaggggatgcttaagttattgctgtcaggtgcatctgccatacaacctgcccctatccctgatcgctgatccctgaccccagactgatctgactttgagccactgtccctgcctgtcttcggaaccacttactgctggttccttgttccctaggatgctgaggccttcaccttgccaaccagcttcgaggaggggaaggagaagtgtccttatgacccagcccgtggcttcacaggcctcatcattggtgagcaggccttcttccctatcacagacatggtatttttaggatgtggatctcatctctaggacctgccaccatgtatatgtcatgtgccctgttgaatatgacatgtctctcatgcctggaatatccccacgccagatggaggcctctacacagccactaggtatgaattccggagcattcctgacatccgccggagccgccacccacactccctgagaactgaggagacaccaatgcattggctcaatggttaggaggatgaggcacaggatgatggggggtaggggactatttcttcatttttactcccttggccagctgaccaccccacccccaaatccccaggtgagcctgtccattccattcctgtgtgttgtcaagtgaggggtcagcctcagagtgagggaaaggaatccccagcctgtctcaaaagcctct

SEQ ID NO: 364626 - DNA, 390 bp, Homo sapiens
caacagcatcaagatcatcaggagagatgcaccatgggacgcatcagcagtgactgatctgccccagagcaagtgcagccaaagctctccgtgcactaaatactgactgtactccagacaggcctccaagggcacagctgggcataccctgtagttatcttacttcctgtagttattttaattcctggcccctctttccctaaatccaattgttagcaaagactcccctcaacctttttttttttttgagaagggggtcttattatgttgcccaggctggtcttgaattgctgggctcgagcagtcctcctggttcagcctcctgagtagctgagattacaggtgtgagccaccgcgcccacccatgttcatattttaaatttatagaaa

SEQ ID NO: 364627 - DNA, 2573 bp, Homo sapiens
gcttccggctttcgctcgcttccatatccgctcctctagtcgccctccgctggccccgccttcgtccccggaagattgggtcctctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactga

SEQ ID NO: 364628 - DNA, 2440 bp, Homo sapiens
gcgcaagacacaggaggcccaggccggcagtcaggacatggcggcgatttgcagattccaatcttaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactga

SEQ ID NO: 364629 - DNA, 2518 bp, Homo sapiens
gcttccggctttcgctcgcttccatatccgctcctctagtcgccctccgctggccccgccttcgtccccggaagattgggtcctctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttagtatttactatctgtgacaatgaccaataaaatgtgtcgacgcggccgcgaatttagtagtagta

SEQ ID NO: 364630 - DNA, 2654 bp, Homo sapiens
gcgcaagacacaggaggcccaggccggcagtcaggacatggcggcgatttgcagattccaatcttaccgcctctgtttctgcggcgattgaacagccgagctttgcggccgggatcgcggaaagtgatggctgtcgtcccggcgtctctctcaggacaggacgtggggttagtctagcttttctcctccccacttttgcggaaagccgggcctcgccgggagcctgtggggactaagcggagggcgcccgctccccggtgggctgcgttcgagtcccgccgccgggcgcggctttccggggcgcctttgcgggtttcgcggactggctcggaggcgaagggaggcggccccggggagggagcctgcccgcggcggctgctcatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactga

SEQ ID NO: 364631 - DNA, 2523 bp, Homo sapiens
gcttccggctttcgctcgcttccatatccgctcctctagtcgccctccgctggccccgccttcgtccccggaagattgggtcctctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactga

SEQ ID NO: 364632 - DNA, 522 bp, Homo sapiens
tgttagagaaagtatagatttgatggtcatgtaaagagttttgtagatatttagtagttttttagcaatgtccccccatcccgctacataatggagttttgttggctattcagaagaagggtgaatattttgtactttttctttttcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagt

SEQ ID NO: 364633 - DNA, 2756 bp, Homo sapiens
gcttccggctttcgctcgcttccatatccgctcctctagtcgccctccgctggccccgccttcgtccccggaagattgggtcctctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactgaaaatctccttggttttattttctagtggggaaaagtcaagaaaggaagattaaaaatgagatttatataaaaagagacataatatatattctagatgttgccaaaagcagttattaaatatcatttataaaaggttattagtctatgctcttgctaagtattaaaaaagatttttgcaaaatg

SEQ ID NO: 364634 - DNA, 2425 bp, Homo sapiens
gcttccggctttcgctcgcttccatatccgctcctctagtcgccctccgctggccccgccttcgtccccggaagattgggtcctctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtaagcaaacgcggggccgcgcacgcgggaaaagcattccccgggtgtcctcgccgaagcgacccgccgcgtatggcaatcagcgataccgcgaacagcaatacgccctatgaaccaaagacagtactccacgagtgacacgaaacgaaacacaacggagccgatagcaatagaaggcacaaaaggtgagagagcaaacggacgtgggcaccacgtgagccacagctcaaccaacagagcccaaggaacacacgccaaagacgctaacacatacaaaggcgggagaacaaacacggacgcacaaacagcccggtcgcaatagagccaggacagcgc

SEQ ID NO: 364635 - DNA, 2334 bp, Homo sapiens
gcgcaagacacaggaggcccaggccggcagtcaggacatggcggcgatttgcagattccaatcttaccgcctctgtttctgcggcgattgaacagccgagctttgcggccgggatcgcggaaagtgatggctgtcgtcccggcgtctctctcaggacaggacgtggggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactga

SEQ ID NO: 364636 - DNA, 1901 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364637 - DNA, 536 bp, Homo sapiens
gaggggccatcttttttgtgccacaaccattagcatctcccaaggtcctgctaaccacgggcaagaaatgttgccctaggataaagatggaggaaacaaatcttgatgaaatattgcctctgtgtataagctttgaacttctgaacttaattcaatgattttaatttaggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364638 - DNA, 1161 bp, Homo sapiens
cattaccggtaacaatagaacattataaagatcttgttaacaaaagtagcttcttgccagagtctttttattaacacttgcaacgctatttaacaagctggccatgcctgtgtgacaccaaaccgcatgtggataaattcagtgtttcatctccaggcccaccaattcctatcctttgtaactaataatgttaacacgacagatcaagaaactagtttttcagaaagcagttttcattcattctctatagacatttccgccgcagtgaacatgcccgcactcagggtgtctgtgcatggccccaactttcctccaagccggggaggatgcaacgtgggccaaccatcccgcgcgctcggccctggaggctgcggggagcgacgcagcgcgacattcacccccaggaaagcgctgctttccgcagaggagagaggctgactgtatccttagctcggctcctcgcttccccagcggctcgccccagacattgcaccgcggaggggaggccggtcgacctctccggcgatgcccggcttctgcctgctgtgggagggcagcggcgggcaccgtgatctccgcaccgagaagagctccccttgccctctagtcgaagctcccgagtgctcggagcacgctcacccctcgcgaacacacccctgcagccgaagcagcccctgaagcccgcagcgcctgcaacaggtccggggcagtgggggaaacttacagcagtggcgactggccgcaacgcacaactgagttctagcgacggtcacgggcaaggaggcgacgaaccggtcgtctcagcccagggaagcggtggcgaatgccccggagaaaggagggccagccggggagaggactgcgccccgaacgatggctcgcggaccggctaccgatggcgttcgcctccgtctgtcgtccccacgccgcggacccggtgtccaggacccgcagagcgtctccggagcgcgtcacggtagggcagagcaagcctgccactgcaggcgccgcggaaggaggcgggctgtgcgctcgggggagggagctagaaagcgccttgtgtgccggcggccgccaggcgtctggaccgggtctccgcagcgccaccgccgcaccgcctcctctccggctgccagagcagtctgcgccccgccgccgtgc

SEQ ID NO: 364639 - DNA, 402 bp, Homo sapiens
ctgcagagcacctggcattatgtaaatatctgtaaatatttgtggattgtcagtaactgttacatgtaatttatgtgatatgacaggctagatcgtggtccctaccattttaagacagccataaaattgtaagagattgctgtttgtacaatttcctgagttgcctaccaactcaatttgaggccacttcttcctatcttaggggcatgtttaactcattcattcagcaaatgattattaaacccccatactatgttaggttctgtatcaagtgctaaaaaggaggaactacttgtgacacttcccaacttgagctgcttctgctataaagctgaactatactaaaaggcacctctcaaaatgcaagaaatccttggtagaaaatgtacatgttttaaatat

SEQ ID NO: 364640 - DNA, 340 bp, Homo sapiens
tggtcttcattcttcagccagcccagccagcttccctctcggacccacagttgggctttgaatctccagcagcagctggtgtggaggcttcaagctctgtcctcagagagaggtgacaaccatttcaaattctacacataaatggtggggcccatggaaatcaaatgctgaatatggtacagcaagggaaaaggtccagcttttctctccctttgaggggctgattaacattgacattaatccacaattacaagacaaggactagatcacaggtttgttcattcatatttaaaccatgtgctacttgcaccaaaaatcccacccccctccctcgcccctt

SEQ ID NO: 364641 - DNA, 2660 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataacccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364642 - DNA, 2815 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacattgtgtttatcagcttgcctccatactgtgagagtctgggcttctacaccagcagaggcatcaaatacagccactgcaccatccaacactcttaggcaccgctcaacctccaaggtaaagtccacatgacctaagaaaaagataagacgtataatgccttctttttaacaaaaccatcatatgatccagcaatctcacatctcactcctggggaggggtgtgtgtgtatatatatgtgtatatatataaaggtattgaaagcagagtctcagagctatttgcacaccctccatagcagcactggtagacaaaaggtggaaaaaacccaaatgtccactgatgtatgaatggataaacaaaatgtgatatacacatacaatggaatactacacagaataaaaaagaaaatattgtagcacattgtcacatgctacaatatgagaaaatttgagggctttatgctaatgagataagccaatcacaagaggacaaatacggtatgattccacttacataaggcatctaagctagtcaaatacataggtatacaaagtacacagtggttagcaggggtgaagggagggggcaaaagggaattgttgtccaatgaatatagtttcatttctgcaagataaaaaagttctggacatctgtttcacagcaatgtgattatacttaacactactaaactgtacacttaaaaatggttgagatggtaaattttgcaacacatgtttttttaccacaataaaaagcaaaac

SEQ ID NO: 364643 - DNA, 2393 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364644 - DNA, 1945 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggaataaagcagaaatgatgctgtgttcttctcagtgcttatcaggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364645 - DNA, 1852 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364646 - DNA, 3055 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364647 - DNA, 1503 bp, Homo sapiens
gcaggacatccaaatggagatgtacaggaggcagttagagaaataggtcatgtgcttgggagaaaataatagtccagaaatatcaatgacatgtttaggaaacttattgtgtgtcattgagggattaacaaaagtgtgtgtgtgattttaaatcctcaatacagatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364648 - DNA, 1866 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacttggaatagctggaccacctctttagctggtttgttaccctgtgaaactgtacaatgcgggggaaaaaggccagattgtttacaccactttctttgaacccgtcacacaatttaacgggttggacaaccaattc

SEQ ID NO: 364649 - DNA, 3080 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaaggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364650 - DNA, 1066 bp, Homo sapiens
gtaccatggagagctggggccagagcatcactttgccggagttacgcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364651 - DNA, 1789 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364652 - DNA, 1450 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaagtaagttgtttgaaagcctatttctgtattaatgctttttgtaaaagtttatttagtaatgtgctttattttttacattttctctacatcctttgcctaagtgtagatgtgaaaaatcactaaaggaggcaatacccactgcttgctttaaatcagtaacatgg

SEQ ID NO: 364653 - DNA, 1890 bp, Homo sapiens
gaggggccatcttttttgtgccacaaccattagcatctcccaaggtcctgctaaccacgggcaagaaatgttgccctaggataaagatggaggaaacaaatcttgatgaaatattgcctctgtgtataagctttgaacttctgaacttaattcaatgattttaatttaggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364654 - DNA, 1959 bp, Homo sapiens
  misc_feature (8)..(8): n is a, c, g, or t
  misc_feature (22)..(24): n is a, c, g, or t
  misc_feature (32)..(32): n is a, c, g, or t
  misc_feature (36)..(37): n is a, c, g, or t
  misc_feature (40)..(41): n is a, c, g, or t
  misc_feature (43)..(44): n is a, c, g, or t
  misc_feature (46)..(46): n is a, c, g, or t
  misc_feature (50)..(50): n is a, c, g, or t
  misc_feature (53)..(53): n is a, c, g, or t
  misc_feature (59)..(59): n is a, c, g, or t
  misc_feature (64)..(64): n is a, c, g, or t
  misc_feature (67)..(67): n is a, c, g, or t
  misc_feature (69)..(69): n is a, c, g, or t
  misc_feature (72)..(74): n is a, c, g, or t
  misc_feature (82)..(82): n is a, c, g, or t
  misc_feature (85)..(85): n is a, c, g, or t
  misc_feature (88)..(88): n is a, c, g, or t
  misc_feature (92)..(93): n is a, c, g, or t
  misc_feature (97)..(97): n is a, c, g, or t
  misc_feature (101)..(101): n is a, c, g, or t
  misc_feature (103)..(103): n is a, c, g, or t
  misc_feature (108)..(108): n is a, c, g, or t
  misc_feature (112)..(112): n is a, c, g, or t
  misc_feature (114)..(115): n is a, c, g, or t
  misc_feature (119)..(119): n is a, c, g, or t
  misc_feature (122)..(123): n is a, c, g, or t
  misc_feature (125)..(125): n is a, c, g, or t
  misc_feature (127)..(128): n is a, c, g, or t
  misc_feature (133)..(133): n is a, c, g, or t
  misc_feature (138)..(140): n is a, c, g, or t
  misc_feature (147)..(148): n is a, c, g, or t
  misc_feature (155)..(155): n is a, c, g, or t
  misc_feature (160)..(160): n is a, c, g, or t
  misc_feature (167)..(168): n is a, c, g, or t
  misc_feature (175)..(175): n is a, c, g, or t
  misc_feature (177)..(180): n is a, c, g, or t
  misc_feature (185)..(185): n is a, c, g, or t
  misc_feature (190)..(191): n is a, c, g, or t
  misc_feature (196)..(196): n is a, c, g, or t
  misc_feature (199)..(201): n is a, c, g, or t
  misc_feature (203)..(204): n is a, c, g, or t
  misc_feature (217)..(220): n is a, c, g, or t
  misc_feature (228)..(229): n is a, c, g, or t
  misc_feature (231)..(231): n is a, c, g, or t
  misc_feature (234)..(236): n is a, c, g, or t
  misc_feature (238)..(240): n is a, c, g, or t
  misc_feature (243)..(243): n is a, c, g, or t
  misc_feature (246)..(246): n is a, c, g, or t
  misc_feature (252)..(252): n is a, c, g, or t
  misc_feature (260)..(262): n is a, c, g, or t
  misc_feature (267)..(272): n is a, c, g, or t
  misc_feature (274)..(274): n is a, c, g, or t
  misc_feature (277)..(277): n is a, c, g, or t
  misc_feature (279)..(281): n is a, c, g, or t
  misc_feature (286)..(290): n is a, c, g, or t
  misc_feature (292)..(292): n is a, c, g, or t
  misc_feature (298)..(301): n is a, c, g, or t
  misc_feature (304)..(304): n is a, c, g, or t
  misc_feature (323)..(323): n is a, c, g, or t
  misc_feature (329)..(329): n is a, c, g, or t
aaaaaggncaaccaaaaacaannnagccaggngcgnncannanngngggnagnagaaancaaanggncnccnnncacaaganggnaangagnnaaanacancncaganccgnannaacncannananncacancagcnnncggcccnngaagccnggcgncgccggnnaacgganannnnaggancgagnnacaanagnnnannaaagacgagaaannnnaaccgcgnnanggnnncnnnacncanaaacanaaacaacnnngcagnnnnnnanaancnnngctannnnnanaaaatnnnnagncaacaaacctcactccaanattagngcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364655 - DNA, 1699 bp, Homo sapiens
  misc_feature (310)..(310): n is a, c, g, or t
ttggctgcgcgtccgcttcgctgattaactctccctgctcgtgagaggcggttcgggagtctatcacctgactcgctttgttctccgtgccgccgctgtgatagtctgctgcgcggccgcgcgctcgtttggtggggctcgctatattcgtccgttgtggctggtgcctgttgtacgagtgtagtctgttcttgtctgtttttcgtcgtcatgactttttcgtctcttgttgtctttcgcttttgttttgtttcttctttttttttctctcttttttttttttttttttttttttttttttttttttttntttgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364656 - DNA, 889 bp, Homo sapiens
  misc_feature (794)..(794): n is a, c, g, or t
  misc_feature (797)..(797): n is a, c, g, or t
  misc_feature (799)..(799): n is a, c, g, or t
  misc_feature (806)..(807): n is a, c, g, or t
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctgagccaggnttnanaagttanngtctcctggcctatgtgaccgtctttccaattagctcattcgagtagcaaggaacttctgtcctttccgagcctgtcataca

SEQ ID NO: 364657 - DNA, 938 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttgtaagtacctatgcaatgtgagtgtattatatcccaggtgctcgctgacggacttaagtgccaaaaactgactccatgctaggaaccactgagttctcaaccagtgagtttatgattcctattttaaaaataacctttaaagtctgattataaaagtagtacatagtctttgtggaaaatttattaagtacagtaagtgcagaagaagaaataaatcactcataatcccagcagatagaattaatcactgtcattttaggtgtatttttttgcagagtaaaacatgtaaacattttacatagacataaatacaaacatgataagcattgacatgaaaatggcagtaattctgtacatgtgcttcttgtatttttgt

SEQ ID NO: 364658 - DNA, 600 bp, Homo sapiens
gtatgggatttacctgataacatttaagaattaaggtgccttagctttccttctctgtctaaacacaaaagtgctaaacataaatttaaactgcttgcggggggatgtgtgatttaaattttaggcctcgggcaagtgctgttggtgagagactctggagttccaaagatgtcagagatatggatgacgcctatgacagactgacaaggcaccgctgcaggatggtcgagtaagaaatctattaagtccagtgtgatttttaaccttcttattcagtgttagtttcttttgctataaatagaaatgtatgttacctaacaaatagtaattagaagaaaccaggaattatttttttgtaagtaataatacctgtaaagatatattcagacttgtgactgttttatagatacaaaaaatgttggtgtaacttagaactccatcttgagttgctttaattttcttcccttattttcagtaatgctgtgatttagtgattctaatttaagtttctaagatgacatgaatatcaatctaaaatatctttatgaatgatatcaatctaaatcaatctaaaatatctttattcatgttatctacaga

SEQ ID NO: 364659 - DNA, 347 bp, Homo sapiens
ctagctcttagtaaacatgttcatcttttgtgtataaaatcttgtagcttcaataaaatgacgtagtaaaatcatgtggaaaaccagatctttataatgagtacacttcttttaaaaagaatcttaatattttcttctaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttggtaagatgattccttaaaaccccttt

SEQ ID NO: 364660 - DNA, 474 bp, Homo sapiens
aagtttaatgttcttcactggcacatagttgatgaccagtctttcccatatcagagcatcacttttcctgagttaagcaataaagtgagtaaattgtattgtactctgtctacaaaaacattgggtatagtttcattacaagtttgtagcttaaatgtttgttcttatggatagaatcaaagtgtaaaaatcagatgtttatggtttttaatttttttggctgtgacttagcattttacatccataaaactttttttgttattgttataacggttactgtaattgttactgtgaatataaacaatcttggggaagtgtaaatcgaaatttaacaaggtagaagccctgaataattctcaaattacatatggttaagataatatatttatcaagttgtccaacagtgtatttgttttaaacataattgtttggaaatccataaatgactatttttctctctgagaaactacatga

SEQ ID NO: 364661 - DNA, 562 bp, Homo sapiens
tgcagagcacctggcattatgtaaatatctgtaaatatttgtggattgtcagtaactgttacatgtaatttatgtgatatgacaggctagatcgtggtccctaccattttaagacagccataaaattgtaagagattgctgtttgtacaatttcctgagttgcctaccaactcaatttgaggccacttcttcctatcttaggggcatgtttaactcattcattcagcaaatgattattaaacccccatactatgttaggttctgtatcaagtgctaaaaaggaggaactacttgtgacacttcccaacttgagctgcttctgctataaagctgaactatactaaaaggcacctctcaaaatgcaagaaatccttggtagaaaatgtacatgttttaaatatattgttaagcttatgatctaaaataactataatttttttgtaatactagggttttggatattattgcaaccataaacaagggatccattgtctggcaggaggtttttgatgataaagcaaaggtgagcattgtgaagactgcatctgatcaatataagaga

SEQ ID NO: 364662 - DNA, 617 bp, Homo sapiens
tttatagtttcatggtttttccagccatttttccctgttgcatttagataccttctaaaagtgactatatttgattataaaaattctttctcatgatgccataaatttattaaggaaccagtattttattaaattactattcttcttttgtctatattgaaacaacccccagggtatgggtacaatgaagtaaagcacttttattagatgagtagagaagtgcaatggatttttttttaatttggctttgattttagaaattatggtagagggtgtaggtataacaatatattttagaggatagaggtataacactatattcaattatatttgccttacctggttatgagtctgtttgaataatataacttttatcatctcaatttgttgatttataaattaatgcaataaattttactttcctcaggtttagagacctttagccagttagtttatcaagattcttatggaactgtaagtatgattattatatgttactaaaaattgttagacaaattgctaatagaaaaaaatgtaacctgtttagctattgcttcctgaagatttcatttccccagatatttgtcttagccggtaaatgtaaatttcatacattt

SEQ ID NO: 364663 - DNA, 793 bp, Homo sapiens
gaggtgttccacttcatctcctcccaaatgaatgaattgatctggaaacacctcactaatttgggaggagatgaagtggaatttaaatgtgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364664 - DNA, 3255 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364665 - DNA, 2217 bp, Homo sapiens
  misc_feature (1926)..(1927): n is a, c, g, or t
  misc_feature (1932)..(1932): n is a, c, g, or t
  misc_feature (1935)..(1935): n is a, c, g, or t
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaaaaaaaaaaaaaaaaaaaaaaaaaannggggntanggggggggggggaaaaaggggtcatggaaagggaccgtggctcaaaggtgtctcctggacccgttttctgtgtccccaagggggaatatcgggggcgcccctaaggggagcggaaaatatatcggaaagaagcggtaacccgtaatgatttcctgccaaaagacagttcttagtcggcacggaagttccagtagcgacggcggggagcaccaacactagtggacagaaagtgtcacaagagactataacagagagcgactcgaaatacaccaccagacgaga

SEQ ID NO: 364666 - DNA, 3625 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgagtaagaaatctattaagtccagtgtgatttttaaccttcttattcagtgttagtttcttttgctataaatagaaatgtatgttacctaacaaatagtaattagaagaaaccaggaattatttttttgtaagtaataatacctgtaaagatatattcagacttgtgactgttttatagatacaaaaaatgttggtgtaacttagaactccatcttgagttgctttaattttcttcccttattttcagtaatgctgtgatttagtgattctaatttaagtttctaagatgacatgaatatcaatctaaaatatctttatgaatgatatcaatctaaatcaatctaaaatatctttattcatgttatctacagacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364667 - DNA, 2461 bp, Homo sapiens
cattaccggtaacaatagaacattataaagatcttgttaacaaaagtagcttcttgccagagtctttttattaacacttgcaacgctatttaacaagctggccatgcctgtgtgacaccaaaccgcatgtggataaattcagtgtttcatctccaggcccaccaattcctatcctttgtaactaataatgttaacacgacagatcaagaaactagtttttcagaaagcagttttcattcattctctatagacatttccgccgcagtgaacatgcccgcactcagggtgtctgtgcatggccccaactttcctccaagccggggaggatgcaacgtgggccaaccatcccgcgcgctcggccctggaggctgcggggagcgacgcagcgcgacattcacccccaggaaagcgctgctttccgcagaggagagaggctgactgtatccttagctcggctcctcgcttccccagcggctcgccccagacattgcaccgcggaggggaggccggtcgacctctccggcgatgcccggcttctgcctgctgtgggagggcagcggcgggcaccgtgatctccgcaccgagaagagctccccttgccctctagtcgaagctcccgagtgctcggagcacgctcacccctcgcgaacacacccctgcagccgaagcagcccctgaagcccgcagcgcctgcaacaggtccggggcagtgggggaaacttacagcagtggcgactggccgcaacgcacaactgagttctagcgacggtcacgggcaaggaggcgacgaaccggtcgtctcagcccagggaagcggtggcgaatgccccggagaaaggagggccagccggggagaggactgcgccccgaacgatggctcgcggaccggctaccgatggcgttcgcctccgtctgtcgtccccacgccgcggacccggtgtccaggacccgcagagcgtctccggagcgcgtcacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364668 - DNA, 2271 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgagtaagaaatctattaagtccagtgtgatttttaaccttcttattcagtgttagtttcttttgctataaatagaaatgtatgttacctaacaaatagtaattagaagaaaccaggaattatttttttgtaagtaataatacctgtaaagatatattcagacttgtgactgttttatagatacaaaaaatgttggtgtaacttagaactccatcttgagttgctttaattttcttcccttattttcagtaatgctgtgatttagtgattctaatttaagtttctaagatgacatgaatatcaatctaaaatatctttatgaatgatatcaatctaaatcaatctaaaatatctttattcatgttatctacagacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364669 - DNA, 2023 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaaggcctggcatctttcttgtgagacaagcttaaggacacaaaagaaacacaactttgtgataccactcttctgaaggctacttatagtaataacttcatagatgaacagcatgattcagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364670 - DNA, 2505 bp, Homo sapiens
cattaccggtaacaatagaacattataaagatcttgttaacaaaagtagcttcttgccagagtctttttattaacacttgcaacgctatttaacaagctggccatgcctgtgtgacaccaaaccgcatgtggataaattcagtgtttcatctccaggcccaccaattcctatcctttgtaactaataatgttaacacgacagatcaagaaactagtttttcagaaagcagttttcattcattctctatagacatttccgccgcagtgaacatgcccgcactcagggtgtctgtgcatggccccaactttcctccaagccggggaggatgcaacgtgggccaaccatcccgcgcgctcggccctggaggctgcggggagcgacgcagcgcgacattcacccccaggaaagcgctgctttccgcagaggagagaggctgactgtatccttagctcggctcctcgcttccccagcggctcgccccagacattgcaccgcggaggggaggccggtcgacctctccggcgatgcccggcttctgcctgctgtgggagggcagcggcgggcaccgtgatctccgcaccgagaagagctccccttgccctctagtcgaagctcccgagtgctcggagcacgctcacccctcgcgaacacacccctgcagccgaagcagcccctgaagcccgcagcgcctgcaacaggtccggggcagtgggggaaacttacagcagtggcgactggccgcaacgcacaactgagttctagcgacggtcacgggcaaggaggcgacgaaccggtcgtctcagcccagggaagcggtggcgaatgccccggagaaaggagggccagccggggagaggactgcgccccgaacgatggctcgcggaccggctaccgatggcgttcgcctccgtctgtcgtccccacgccgcggacccggtgtccaggacccgcagagcgtctccggagcgcgtcacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggaataaagcagaaatgatgctgtgttcttctcagtgcttatcaggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364671 - DNA, 3143 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaacctttgaccctctatcttattacatttagaggcctggcatctttcttgtgagacaagcttaaggacacaaaagaaacacaactttgtgataccactcttctgaaggctacttatagtaataacttcatagatgaacagcatgattcaggtacagtggctttaaacatcaaagcacatttctcattatataaattaaaacgggtggctccagtgccactatcaaagcttaagttatatcttttatctagttctctgaatgtactgaaacagtactttattcgtccaataaataaagcaataaaaattgttcttactgaaaatgaagtagctaggtgctcctgaatttctctccaaaaactaaaacatttaggtcaaaccacttctccggttgagcagtgtattttgatcttgaggattcatggcttgataagtagatagttctaaggcaaaagtagctgagcctgatgttagcgttcgaagcacagttgaataaccctaatcaaaataatttaagtcatttatattatcaaatttaagcctcaagtttctcttcctgctgattatcttttgactattagggaaaagtgatgttgccacttttgtggcttagccatatcacttcctccaaacagatgatttaacttttttcagggtaagttggatataaaaacattgaggacagaaagcagagtagtgcaagtgtgctgcagatgtatttgttagatggctttgccggcaacccaggtgcctgtcctggagcagaagaggctgacgggagaagaatgataacttgccttaaaactgacaatggtggaagtaagataaatgcttggcagggaaaaaatggtcatataggctggtaccacattttgggactgtaaatacccccttgtagtgctataatccctggatttcgccaacaatttaaattcaaagtcctaaccattcctgctggttgaaacgaaacttaacatgtattctctaaatcaaagccttaatgtttctttcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaaga

SEQ ID NO: 364672 - DNA, 1590 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcgctcagaaacagaaacaacttttcattgtacaggagtgctagggggtatcctctagc

SEQ ID NO: 364673 - DNA, 1350 bp, Homo sapiens
  misc_feature (1070)..(1070): n is a, c, g, or t
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaagcagaaagacctcctgactccatgttacagcatagatggttacaactgtaacnatctatgtggtaaatatcttatgtttataaccttaaagatatgatgaaactgcaattagcatcctatgacaaactgagtttcttgatacactttaaaattataaaagttaggtctggcatggtggctcatgccagtaattctggcactttgggaggcccaggcaggcagatcacttgaggtcaggattttgagaccagcctggtcaatatggtgaaaccctgcctctactaaaagtacaaaaattaactgggcatagatgtgggtacctgtaatcccagc

SEQ ID NO: 364674 - DNA, 1139 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgatgaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 364675 - DNA, 457 bp, Homo sapiens
gcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacggtgagcgctcccggcccggccgggagttgtcctgggggaggggagaggcggaccaccccggagcgctg

SEQ ID NO: 364676 - DNA, 253 bp, Homo sapiens
attccatttaaattataggattggtttttgtatgtttctgcagaatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatt

SEQ ID NO: 364677 - DNA, 1496 bp, Homo sapiens
ttgtggaatttacagttagtattaaggatattcttctacacatgaaaaaatcacttaaatatgagaaaatggcattctacatgtatgtactatgaaatgtgtctgatttggtatgcattatttcaaaaactgtgaatgtgtgttaataacactacagcaatcacacagtgactatagcttgcatttaatgcattacaaaagagggaggacaaactttctagaagaaattaaaaccatatgttattttttgttgctaatcatttgacacttaatcgaaacagaataagttactgtggaaaaaaggatgatccaactcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggagtggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttctgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatt

SEQ ID NO: 364678 - DNA, 404 bp, Homo sapiens
agtatttttaattatggtaaatcatgtaacccagactcatgaattttggggcagtggaaattatttcctttgactcttttttctgcatatcatcaatttgctttttactcatgtttcttctactgtcgctgtaagcttacttgttgttttttctttccttttcttcatgctgtcgtttagagccctacagagagacaagtatgggagtaaagctaaacattgcatatcaaatgtaattttttttagttcacttttattgcatcacatatagatgatgtagttattaaaaacagttcatctcacaatttaaaaactaaaaagcctatgaatcgacttatataaatatatgttaatagagattagacgcttttgttgtctgattcttttattgtcacataatcaac

SEQ ID NO: 364679 - DNA, 6385 bp, Homo sapiens
gaaaaacacgagccgtgttgtatgtggaggccccggtgtctgggtgtaattctcgttccttctgtgaggtgaggcagatgaagccatttcgtggttctgctgagcatggtcttggcagtgtttttgggagcatcacactgtgccccttttgttaacttgctagcccggcctgtcttttgccccgggctcaatggctggattgtggaaactgcacccgccttcaggttgttgagcaactgatgggacgatctcagggaccggcgtttacgaaagaggggaagccaagatacaggagtggaaattacttggccacatcgcacaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcatagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgcgggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaattacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggcccagaacaattgtcctgaaattagtaacaatgcctgcatcctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 364680 - DNA, 6632 bp, Homo sapiens
gaaaaacacgagccgtgttgtatgtggaggccccggtgtctgggtgtaattctcgttccttctgtgaggtgaggcagatgaagccatttcgtggttctgctgagcatggtcttggcagtgtttttgggagcatcacactgtgccccttttgttaacttgctagcccggcctgtcttttgccccgggctcaatggctggattgtggaaactgcacccgccttcaggttgttgagcaactgatgggacgatctcagggaccggcgtttacgaaagaggggaagccaagatacaggagtggaaattacttggccacatcgcacaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcatagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgcgggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaattacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggcccagaacaattgtcctgaaattagtaacaatgcctgcatcctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 364681 - DNA, 3017 bp, Homo sapiens
catttatatggtttcaatcactggtccaattatacacatatatagatttaatagtattttctgtttccttccaaacattttatacttaagtaaatgctagcaatttatacatatttcatagtcaatgaatgtttttgcttctgtgtttgtgtgtgtgttctatggcttgttggatataaatgtcatagtatcttgtaatctttttcagaggggcttctgaacaatgccagggatacaagtgtcatggatactctaccactgaatggtaaccatggcaatagttacagcattgccagcggcgaattacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggcccagaacaattgtcctgaaattagtaacaatgcctgcatcctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactatatgattaatcagtctttttatttttctcgcctttctttctttctgttttcaatacataaactttgctaatcctctgtggcccaaatgagccatgcaaaagaaatcaatctgcctagatgaataagctaagcacaaaatcatacaggtttgcagacaaagtaaaccagaaaaatggaatgggcatgtttattttggatgaaatcagatgcataacttaatgttgagcaggttaacatatatgttactatttgcttatctataaaccagctgcagtcactatgcttacctttaaaaccagattcaatcagagatataaatatgaaatttgggggctgggtgagtcatattttttcctcctttgtacattgcattttgatgttagaaattcaaattccctcaatttgctaaaagctgcaaagagaatattcattttataaagatataat

SEQ ID NO: 364682 - DNA, 1457 bp, Homo sapiens
atgacagtacttgatgtttatatactctgaagcatttcttcaaactttctactttatgtgtcattgggattaaaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggcccagaacaattgtcctgaaattagtaacaatgcctgcatcctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 364683 - DNA, 691 bp, Homo sapiens
  misc_feature (131)..(131): n is a, c, g, or t
actctctccaaccaacccacttctgactctgagtcctctctgcctcctcccctcacccgctctcgggcccaatgtgctcagcaaccagctcccttgcttcctctccgggaagtagcgggagttgaggggancctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 364684 - DNA, 1331 bp, Homo sapiens
gaaaaacacgagccgtgttgtatgtggaggccccggtgtctgggtgtaattctcgttccttctgtgaggtgaggcagatgaagccatttcgtggttctgctgagcatggtcttggcagtgtttttgggagcatcacactgtgccccttttgttaacttgctagcccggcctgtcttttgccccgggctcaatggctggattgtggaaactgcacccgccttcaggttgttgagcaactgatgggacgatctcagggaccggcgtttacgaaagaggggaagccaagatacaggagtggaaattacttggccacatcgcacaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacagtatgtatattcctatacttttcttggcaagagaaaagatactaaactgtgttttgcatgcattgacaaatattctctatgaaaacataaatcacgtaaattaaatgaaaaaattggctaatattaatttttgagaatcatagaccctccctgccatcagaagaattagatattgcctaccctctcctacggcatttacttgtgattatttctgtatatgaatacgtgttctaacacacttttcttaattaatgcaagaatataaaacatttagaaaaaggttgggggagtgttataccaattctccaggtccaagcagataagaggtgaaaatgagcaatacaattttatatgtaatgtatagcagttgatacattttgaatttgatagaattgtatctaagcttcatctgctgtcaacattttgagaattagaaatatattcatccagaaggagt

SEQ ID NO: 364685 - DNA, 477 bp, Homo sapiens
agggcaggcacatcatggacaagtttcatacatttctccgccaattcaccttgactctgagctagaaagaccctctgttaaaggtgagtttttctttatatgaagaaaaagtaactctgctcattctttgatgaaagcaatgatggttgtacatatgtattttgtaatgcagtgcctgttcaaaaagcaggggtaaaatgaagtatgtgagtaatctggagataaagcaagtctcatttataaacaaaaatgtgaaatatttctctgagaaatgtttgtaaactaaaatacaatggcttcaataaatcagtatttatagtgattcaactagtggaggactagttgaataccaatttagatttagaaattaccagataaccgttaacttttttactgggaccttctttttctactatcttatttttttttttttacattaagatgtcttaatctaaatcatattgacagatttttttc

SEQ ID NO: 364686 - DNA, 282 bp, Homo sapiens
aatagaataagaattccagtattttgatttcagaaatactgcaatggtttaggaaattattgtagcttaggtatgtttctcaatgagcactgatatctctttgatattaacagaattggaagttgcaagactgagcacagaaggaaacttagaagacctaaaatttccagaaaacatgggccatggaagcactatccagctgtctgcaaataccttaaagcaaaatggccgaaatggtaggttagagtttattttttaagcttgagggaattgaacttgcat

SEQ ID NO: 364687 - DNA, 6520 bp, Homo sapiens
gaaaaacacgagccgtgttgtatgtggaggccccggtgtctgggtgtaattctcgttccttctgtgaggtgaggcagatgaagccatttcgtggttctgctgagcatggtcttggcagtgtttttgggagcatcacactgtgccccttttgttaacttgctagcccggcctgtcttttgccccgggctcaatggctggattgtggaaactgcacccgccttcaggttgttgagcaactgatgggacgatctcagggaccggcgtttacgaaagaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcatagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgcgggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaattacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggcccagaacaattgtcctgaaattagtaacaatgcctgcatcctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 364688 - DNA, 2554 bp, Homo sapiens
catttatatggtttcaatcactggtccaattatacacatatatagatttaatagtattttctgtttccttccaaacattttatacttaagtaaatgctagcaatttatacatatttcatagtcaatgaatgtttttgcttctgtgtttgtgtgtgtgttctatggcttgttggatataaatgtcatagtatcttgtaatctttttcagaggggcttctgaacaatgccagggatacaagtgtcatggatactctaccactgaatggtaaccatggcaatagttacagcattgccagcggcgaattacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggcccagaacaattgtcctgaaattagtaacaatgcctgcatcctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 364689 - DNA, 3270 bp, Homo sapiens
gaaaaacacgagccgtgttgtatgtggaggccccggtgtctgggtgtaattctcgttccttctgtgaggtgaggcagatgaagccatttcgtggttctgctgagcatggtcttggcagtgtttttgggagcatcacactgtgccccttttgttaacttgctagcccggcctgtcttttgccccgggctcaatggctggattgtggaaactgcacccgccttcaggttgttgagcaactgatgggacgatctcagggaccggcgtttacgaaagaggggaagccaagatacaggagtggaaattacttggccacatcgcacaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcatagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaaggcaatggtcgagacagttaacaacctccttcagccacaagctttgaatgcatggagagacctgactacgagtgatcagctgcgtgcggccaccatgttgcttcatactgtggaggaaagtgcttttgtgtggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 364690 - DNA, 376 bp, Homo sapiens
aataaaaatccttctgaatcctatatacctatctgcctgcagcatcctcccttctctgtctctgtctccattgcctcaaatcagtccaatctaacttctacctcaatgaaaccaacaacaacaaaaaaggtactcgtgatctccaccttcttatccctaatggacattttatttgctctctaggcaacactcagcaaaattgaccacatcgtccttaaactacagtggtcccagctcacgtgagacttcactttcgatggtttcagttacctgtgatacagtaaaataagctattggggtcgaaggtaggggacagattcccataacttttattacagtgtaattgttctgttttatttattttttgagatggagt

SEQ ID NO: 364691 - DNA, 1272 bp, Homo sapiens
  misc_feature (171)..(172): n is a, c, g, or t
cgcccgcgctgcgccgcgctgcgccgcgctactgctgcgggggccgctggggggcgcagctggggcgcggctcggaggggaggctagggggccgtgccaggcccgaagccgaggcggggccgggatgcggcgctgaggcccagcatggcctggccgggccccaccttcccnnctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagcgcagtcctgcaggaggcagtcagcactggagaccccgagatggtgcagctggtgctccagtatcgggactaccagagggccacgcagaggctggcgggcattccggaactgctcaacaaacttcgccaggcccagggtcacgtaggaaagagagacggccaggctcacgtgggagagactggaccctttggaagagaagccttgccagctttgggcctcctgaagaatgcagattacctggagcagggacttcaggttgactcggtggattatggcctgaaaccctggaatacttgctactacgcacccttctggaagcacacggaggggcctggctggcagagcatactatctcataccccctaccccaggagcaggctcggagggagccactgtgccccctttacagagtaggactctgagacccagtggaaacaaaggctcccccagggctctgcacaggctcatggccaggttgaggctggccctccacctccaggtgcttacagcctcattgtctgaagaccactgtagtgccccacttggcccaccctctccagggcagagtggttgggcgtagctgagccatagcagtgcgtcaagacttgatgaagggccaggcgttgtggcttactcctgtaatcccagcgctttctgaggccaaagtgggcggatcacttgagcccaggaggtggagaccagcctgggcaacatggtgaaagccgtctctacaaaaagtacaaaaattagctgggagtggtggcacacacctgtggtcccagctactcgggaggctgaggtggaagaatcacctgagcccagggaggcagaggttgcagtgagccgagattgcaccactacactccagcctgggtgacagagcaagtctcaaaaaaaaaa

SEQ ID NO: 364692 - DNA, 1416 bp, Homo sapiens
  misc_feature (171)..(172): n is a, c, g, or t
cgcccgcgctgcgccgcgctgcgccgcgctactgctgcgggggccgctggggggcgcagctggggcgcggctcggaggggaggctagggggccgtgccaggcccgaagccgaggcggggccgggatgcggcgctgaggcccagcatggcctggccgggccccaccttcccnnctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagcgcagtcctgcaggaggcagtcagcactggagaccccgagatggtgcagctggtgctccagtatcgggactaccagagggccacgcagaggctggcgggcattccggaactgctcaacaaacttcgccaggtacagcagggcacagttatggaggtggggtaccatggcagggcaccaccctggttactgtgccaggcctggccttggaaaggcacccagtttgtgcagtgtgcctcctgccaccagcaaggaggtctgtctatcttgaccccagcccagggtcacgtaggaaagagagacggccaggctcacgtgggagagactggaccctttggaagagaagccttgccagctttgggcctcctgaagaatgcagattacctggagcagggacttcaggttgactcggtggattatggcctgaaaccctggaatacttgctactacgcacccttctggaagcacacggaggggcctggctggcagagcatactatctcataccccctaccccaggagcaggctcggagggagccactgtgccccctttacagagtaggactctgagacccagtggaaacaaaggctcccccagggctctgcacaggctcatggccaggttgaggctggccctccacctccaggtgcttacagcctcattgtctgaagaccactgtagtgccccacttggcccaccctctccagggcagagtggttgggcgtagctgagccatagcagtgcgtcaagacttgatgaagggccaggcgttgtggcttactcctgtaatcccagcgctttctgaggccaaagtgggcggatcacttgagcccaggaggtggagaccagcctgggcaacatggtgaaagccgtctctacaaaaagtacaaaaattagctgggagtggtggcacacacctgtggtcccagctactcgggaggctgaggtggaagaatcacctgagcccagggaggcagaggttgcagtgagccgagattgcaccactacactccagcctgggtgacagagcaagtctcaaaaaaaaaa

SEQ ID NO: 364693 - DNA, 699 bp, Homo sapiens
  misc_feature (171)..(172): n is a, c, g, or t
cgcccgcgctgcgccgcgctgcgccgcgctactgctgcgggggccgctggggggcgcagctggggcgcggctcggaggggaggctagggggccgtgccaggcccgaagccgaggcggggccgggatgcggcgctgaggcccagcatggcctggccgggccccaccttcccnnctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagcgcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccagggtgagctc

SEQ ID NO: 364694 - DNA, 534 bp, Homo sapiens
gagtggagcgatttagaagtaccaaattaagaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctctaaaaaaaaaaaaaaaaaaaaaaaaaaaaaaaaaaaacaaaaaaaaaaaaaaaaaaaaaaacaag

SEQ ID NO: 364695 - DNA, 511 bp, Homo sapiens
acgaactttagctcggtacccccttccctttctcacgatacatggtgatcttaattgcggggcttattctgttaatctgttgttttttcagttctgattcaaaggagtctatgtctactgtgccggctgactttgagacagatgaaagtgtcctaatgaggagacagaagcagatcaactatgggaagaacacaattgcctacgatcgttatattaaagaagtcccaaggtagtcttgtttcagtggcatgtcttgaacaagctgtgtggcattgcgcttctaaagagttgcttagattgggtagtacaaatgatgctggggatagttcacacctgctaagagctatttaatagggacttactggggcttatgacgtaaataaagaatggattggcaactggaaaactaaagacatgaagattttaaaaatcattttcatataattttaaatgttagataacattttatttcttaggagtcagcaatcatagatgtaagcttattaaaata

SEQ ID NO: 364696 - DNA, 1786 bp, Homo sapiens
agcgggagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctctaaaaaaaaaaaacaaaaaaaaaaaaaaaaaaaaaaacaag

SEQ ID NO: 364697 - DNA, 1641 bp, Homo sapiens
agcgggagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctct

SEQ ID NO: 364698 - DNA, 1354 bp, Homo sapiens
agcgggagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatgtatgtctttattgcattcttgtcctgtgattctctgattggtccagtgactggagcagctgcgcaccactgggacaggaggtctggtgccaagtcccccagcagctgttggggagcagagcagctgctgcagctcggtgctgagttcttctgtactgggagggaggcagctggaaggaagagtttgcttcctggattgaatttattttttcaagcaaagtcaatctgggaatacagtttttgtttgttgttttgctgtttttgttgttgtagttgtttttcccctaaaaattacaataatctctggaatttgttttttaaatataaatatcctaaaaagtatttgagtcatttcggctcaaccatgaaaataaaagttcttaattaaggaaggaaggctttctttctctgttggctttttttttttgggagatgctctgtcaccgaggctggagtgcagtggcgtgatcccggctcactgcaaccttcaccttgtgggagaatagcttgaacccaggaggtggaggttgcagtgagctgagatggcgccattgcactccagcctgggcaacagagcaagactctgtctc

SEQ ID NO: 364699 - DNA, 502 bp, Homo sapiens
actgcgttctggtaatgactgcaatagaaagcagatgcctcaggaagttcatgaggaacaagagaaaagggggcacgtttggtctccaggattggagaaggtatgcagtgcccagtaggcatatgagtcccattagtaagtttggtgtttttaaaataatttatttcaatttatgttttgtttttctttttttaaggctgccaagttttagggaatgtaaatttttgttgtgtggatctcactacttaaactgaacctgacaaagatttcttttggcccacggagcttctggattgcataggatggtgtgcctgcgggcatcagggtggagcttcctcagacctggctgctttatttttatatcttttttaaaaacagcaatatttattttgccctcagatataaaaggaaactcctcatcaatgactttggaagagagagaaaatcatcatcaggaaggtaaaggctgtgtaaatgtttcttttctaatttgatagacctg

SEQ ID NO: 364700 - DNA, 1746 bp, Homo sapiens
agcgggagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctct

SEQ ID NO: 364701 - DNA, 1032 bp, Homo sapiens
tgaagaccaggtccctgtggacgaagttgttgcacacgccgagacacctgtctccgcgagatatctcaatggacgaagttgttgccgagacaccataccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctct

SEQ ID NO: 364702 - DNA, 1556 bp, Homo sapiens
tttcctgtgttgtggattcttcctcaagaaatgtttgcttagtccactgtccaagagagttttccccaaagttttcttgtagtagtttcatagctttaggtcttagatttaagtgtttaatccattttcgtttgatttttgtatatggggggagataggactctagtttcattcttctacatgtgggtatccttttttcccagcacaatttattgaagagactgttctttccctaaggtatgttttttgcacttttgtcaaaaatgagttctctgtagatgtatggatttgcttctgggtttctctgttctgttccattggtctatgtgtctgtttttatgccagtatttgatcattacttttatgaaatctactttttgagtagtaattactattctttatgcttttcctctaaaaatgtttttcaggaaaatatctattcattgctttaagcaatctaaagttatagaataaataatcgtaactgctgttttatctgcctgtaacatagagagcacagtgctaagcattctccttcatagttattatccattacattagcattaatgactatgtatcactatccctcatttaaaaattatgtaaaaagagaaatacacctttaagtaaaggacatataagaatgttaggttttggttgtcatacattatttcttacctatgcttggtttttgtttgcttgtctgttgtttatcattctgtttgattctgagtatttccttctgtggttctgaagcactgttcacatctccaacataatgtgcagcatttcttcaaacaatctagagagtagcactggaatttaaactagacatacatgtaaaaaaaaatcattattagaaagaatgttttaaaataaactagataaattttaaataattataagcagttgattcaggagtaaagaggaaaaaaataacttaacgacttaaaataagcctttaaaaaataacttaaagacttaaaaataacttaaacttaagctccaataactcttggagctattgacaactatgaatttgtaatgaacttttctacccactcaggagactaggatagtttctaaaagccatttgggttctcttgcctattaggttggtgcaaaaataattgcagtttttgccattacttttagtagcaaaaaagaatgttatccttcaagcctagaagtaactctattatatcccgttttctttataattgcttttaatggcaaaaactacaattacttttgcacaaacctaatagtttagttatgtctcttataacaatattttaaaatattctttaatcttaggggtaagtaatttaagaaaaactgaacccaccctgtaaaattgactatggtatttctggtaaaactacattatgggattgctattaagatatgattctggccagacgctgtggctcatgcctgttataccagcattttgggaggctgaggcgggtggatcgcctgaggtcaggagctctagaccagcctgaccaacatggtgaaaccccgtctctactaaaaatagaaaaaaaaaaaaa

SEQ ID NO: 364703 - DNA, 2799 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtc

SEQ ID NO: 364704 - DNA, 857 bp, Homo sapiens
cacagcaagaccctgcttcaaaaaaaaaaaaaaaattactggacacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagattataaaaatacagcgattggctgggtgcagtggctcacgcctgtaatcccagcactttgggaggcagaggcgggcggatgacttgaggtcaggagttctcaaccagcctggccaaaatggtgaaaccccatctctactaaaaacacaaaaattaaccaggcgtggtggtgggcacctgtaatcctagctacttgggaggctgaggcaggagaatgaatcgcttgaacccaggaggtggaggttgcagtgagccgagaccacaccattgcactctagcctgggcaacaagagcaaaactccgtctcaaaataaatacatacatacatacatgcatacatacatacagggattaaaatagtctagtactgacacctgaacagacagattgatccaagaaatgaaacagaaattccagaagttgacctgaacacacacacacacacacacacacacacacacacacacacacacacacgaaggcgtgaaagactccatgaccctcaaggtataagatgcatttttttttttttttgagacagggtctcactctgtcacccagactggatgcagtggtgcactatcccagctcagttctaccctccatccccccaacctcccccaaccacc

SEQ ID NO: 364705 - DNA, 476 bp, Homo sapiens
agatccttaaggcgagcccgggtactgtaatcctagctacttgggaggctgaggcaggagaatgaatcgcttgaacccaggaggtggaggttgcagtgagccgagaccacaccattgcactctagcctgggcaacaagagcaaaactccgtctcaaaataaatacatacatacatacatgcatacatacatacagggattaaaatagtctagtactgacacctgaacagacagattgatccaagaaatgaaacagaaattccagaagttgacctgaacacacacacacacacacacacacacacacacacacacacacacacacgaaggcgtgaaagactccatgaccctcaaggtataagatgcatttttttttttttttgagacagggtctcactctgtcacccagactggatgcagtggtgcactatcccagctcagttctaccctccatccccccaacctcccccaaccacc

SEQ ID NO: 364706 - DNA, 548 bp, Homo sapiens
tgggaggatcactggaggccaggagtttgagaacagcctggccaatgtagcaagaccccatctctaaaaaaaagaaattagccagccatgatggcattataggagtgagccactgggattataggagtgagccactgcacctgctctccaggccatgcgcccgggcatgggtcatgttccactggaggaagggcagcttctcctaattcactcaaagctgctgggttggtatggtggggaacatggcgtctggcgtggtacaggagctccgggttaggagggcttcctggaggaggtgacgtctgaacaggcctccccctccgtgtcccctgcagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacagacacagactttcactctgtcccccagactggagtgcaatggcacgatctcagctcgctgcaatctccacctcccagg

SEQ ID NO: 364707 - DNA, 659 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtgagcaccaccgccccgcccc

SEQ ID NO: 364708 - DNA, 5678 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggtaccgcccccacccccaggaccgaggggcgctcagcctctcatcggcccgcgctctccccgcaaaggggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364709 - DNA, 5564 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364710 - DNA, 5298 bp, Homo sapiens
tctgcctccgtctccctcctctagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgactggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364711 - DNA, 4976 bp, Homo sapiens
tttgtctatatttattgtttatttttggaggactgtgtggtctggtgtttgggagggaactccacccccaccaggccaaccatggagctagaaacagagacagcaggaagggcaaagctggccactgcctgctccaccccttcacagcccagagcagaacagggtctggggatgtgaggagctggccagtgtccagggccccgtccccagccaccccttgggaaaatgtcctctttccctgggatgctctgaggtcctcagagggaaaggttcgggatcccccgtgcctctccctgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364712 - DNA, 5814 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgaggtgcgccctccacccgctgggctaggctgggccgggttggactgggctggggcgaggggtgaagagcggtggggaaccagggagcgctggggaggaccagggaggctgtgtcgcagcgagggtcagggacggagcctaaggggagggggctgccaggagccctggtctgggggactccagcccgcgctcttccgcacccctccagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364713 - DNA, 5471 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364714 - DNA, 3854 bp, Homo sapiens
ttggtttcttccgggcttgaccgtcctggcctgtggggaggaagtcacagacctgtccctctgtgcccttccctctaggagttcccttttgtgtcagggtccagagccactgggaaaagtagtgatatcagggccaccaaatatatttggcgggttctggaatacctacgagcgtggccaaggggccagcggcggctgaaatccagcccacaccagcctcctgggctcctaccatcccggtgccttccgtggggacaagtggagctgctgccaccaaaaagacgagacagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364715 - DNA, 3899 bp, Homo sapiens
tgggaggatcactggaggccaggagtttgagaacagcctggccaatgtagcaagaccccatctctaaaaaaaagaaattagccagccatgatggcattataggagtgagccactgggattataggagtgagccactgcacctgctctccaggccatgcgcccgggcatgggtcatgttccactggaggaagggcagcttctcctaattcactcaaagctgctgggttggtatggtggggaacatggcgtctggcgtggtacaggagctccgggttaggagggcttcctggaggaggtgacgtctgaacaggcctccccctccgtgtcccctgcagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364716 - DNA, 3579 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (3021)..(3021): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggtaccgcccccacccccaggaccgaggggcgctcagcctctcatcggcccgcgctctccccgcaaaggggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtcaaaaaaaaaaaaaanaaaaaaaaaaaaaaaaaaaaaaaaaaaaaaaaaaaaaaaaaaaaaaaaaaaaaaaaaaaaaagggggggggggccacaacaaaaaatcatcctcccgcgaaggggcgcgccgcaacactaaagcaacgcacgcacccccacgatgttagtagaaaccagggcggcgccccatagtcgggaggagcagctaatatataaaaaaccggagggacggcggcggcgccgagggaaaaacacaacgacccgggagaggcgggagaagaacaaagacggagcaggtggagaaaaattttatgagagagagaacacatcttattatgggcgggggagcaggacaaaaatataggtgggggaagaaatcacttcctgaaaggtaagataatttaagagccgccgctgagggggcagggaataatatataccaaaggacgacgagggacgtatatgtggggtgtggaaaaaacaacgcgacgcgattagaattcggtcgatgtgcaggagagaacgatgttggtgcacatacaaggggtatttagattatgtacgaacgaatatacg

SEQ ID NO: 364717 - DNA, 4292 bp, Homo sapiens
  misc_feature (291)..(291): n is a, c, g, or t
  misc_feature (3817)..(3817): n is a, c, g, or t
tgtctggctaattttttaaatttctttagagacggggtctcactatgttgctcaggctgctgtaatcccagctactcaggaggctgaggcaggagaattacttgaacccaggaggcggaggttgcagtgagctaagattgcaccattgcactccagcctgggcaacagagcacgactccatctcaaaaacaaacaaaaaaaaagagtgtcacctggggctacttggccagacacagagagcaaggagacatccctattatctgtcaaaaataattgttggggctgagcacngtggctcatgcctgtaatctcagcactttgggaggtcggggcaggaggacttgaggcctagagtttgagaccagcctgggcaacatggcgaaaccccatctctactaaaaatacaaaaaattagccaggcatggtggtggatgcctgtaatcgcagctactcaggagagggcgctggagaatcacttgaactcatggtgcgcaggttgcagggagccaagatggcaccattgtgctccagcctgggcaacgagagcaaaactccatctcaaaaaaaataaagaacctgcgagtgagttcccacacgttttcctaatgggctgctgctttcctaggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatagtttgctctctctctcctagttaacaggctttcaaatattagaagatcaatgttctgaccccattaaaatttctcttttgtggaatgaaaagctctgatttaacccatcttcaaggctggtttgatggaggaataggggctgagtcacctgcatttcccctccctgcacaaagtcctgggcccagatctggggtctgtctctgctgagggtggggtgaaccaggaagcacctccttcttcatctccttgatgaatgggtataatggttgccatggaactggggcttgtttgatgacctggggctgggtgggcctctgagagcctttatagctgattgccttttgggagaggggaggtgggagccccaccctgtctcatgagtcaccccaaaggtgcatgggcaggcaggtgctggggaatcggctactccccagagcttggcgtggccatccctgtggcccctctgggagtctggagcccattccctcacgctggtactcactgcagctggggacatctgcactaggaagacaggacacggcatggaagctggcctctgcccagaagccatgacattctggtcaccagcctgatgctataaaacgagtgtcacggccgggcatggtggttcacacctgtaatcccagcactttgggaggccaaggcgggtggatcatgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacagagcacgactccatctcaaaaacaaacaaaaaaaaaagagtgtcacctggggctacttggccagacacagagagcaaggagacatccctattatctgtcaaaaataattattacagctgtgagccaccgcacccggccgcattcttctaaatcacagtacatctggttcccagtgcccaggctctcagggcagagggtccagtgtgatcactttgcatggcctctctcccctcctgagcttgtgccagggccccagggctgacctggagaaggaaaatggcagagggtgaagatggggtgtctggtttggggaccatcctggccccccttgtcactgttggcatctcttctgcacagtggcattgctgggaggtgcttactgtgcctattcaaggggctggcagccgcagcctcactgcagatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgtggtggctcatgcctgtcaccccagcaccttgggaggccgaggtgggcagatcatatgaggtcaggactttgagaccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccagcctgactccgtctcaaaaaaaaaaaaaaaaaaggcatttcagttcaaatagggaaaggatacatctttctttctttctttctttctttctttctttctttctttctttctttctttctttctttcttctttctttctttttctttcctcccttcctttatctctctctctctctctctttctctctttctttttgagatggagtttcactctcgctgcccaggctggagtacaatggtgcgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattagtttagagacagggtctcactccgtcgcctaggctggagtgcagtggtatgatcatggttcactgcaaccttaaactcctggcctcatatgatcctccggcctcagcctctcaaagtactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccagcctgggcaacatagtgagaccacatctctacaaaaaatttaaaaatgagccaggcatggtggtgcacacctgtagtctctgctattcaggaggctgaggcgggatcattgtttgagcccaggagacagattgcagtgagctatgatggcaccactgcatggcagcctgggtgacaaagggagactcagtctcaaaaaaaaccaaaagttacccagcaacccaagtcatatcctgatgatatccatactcctcagtcatgcatcccgtggtgcgggggctgaccccaagaggagctgctgcccccagagggtggggagccgaggcaggcctnggtcagacttaccaggctatgctcccagcccagccctcactagggacccccgagtgcatctctctcctctccaggcctctgtttctccatctgtgcaaccacagtgttggacatggtagtcccaagtgtctgctcgtaactttgccctctctgtgcccccaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggccc

SEQ ID NO: 364718 - DNA, 2401 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgaggtgcgccctccacccgctgggctaggctgggccgggttggactgggctggggcgaggggtgaagagcggtggggaaccagggagcgctggggaggaccagggaggctgtgtcgcagcgagggtcagggacggagcctaaggggagggggctgccaggagccctggtctgggggactccagcccgcgctcttccgcacccctccagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtgggagaggaggcc

SEQ ID NO: 364719 - DNA, 2279 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaaggtgcggggaggggagcgggtgctgtgggagtggcctgaacactgtgggagtggcttgggtgctgtgggagaggcctgggtactgtgggagtggcatgagtcctgtgggagtggcctgggtattgtgggagaggcctgagctctatgggagtggcctgggtgctgtgggagtgccctggatgctatgggaatgccctgggtgctgtgggaatggcctgggtgctatgggagtggc

SEQ ID NO: 364720 - DNA, 2701 bp, Homo sapiens
  misc_feature (2226)..(2226): n is a, c, g, or t
agcaattctcatgcctcaaccctcagcctcatgagtaactgggactacaggcgtgcaccaccatgcgcagctaattttttgtatttttagtagagatgggtctaaccatgttgcctaggctggtctcgaactcctgagctcaagcgatcctcttgcctcaacctcccaaagtgctgggattacagctgtgagccaccgcacccggccgcattcttctaaatcacagtacatctggttcccagtgcccaggctctcagggcagagggtccagtgtgatcactttgcatggcctctctcccctcctgagcttgtgccagggccccagggctgacctggagaaggaaaatggcagagggtgaagatggggtgtctggtttggggaccatcctggccccccttgtcactgttggcatctcttctgcacagtggcattgctgggaggtgcttactgtgcctattcaaggggctggcagccgcagcctcactgcagatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgtggtggctcatgcctgtcaccccagcaccttgggaggccgaggtgggcagatcatatgaggtcaggactttgagaccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccagcctgactccgtctcaaaaaaaaaaaaaaaaaaggcatttcagttcaaatagggaaaggatacatctttctttctttctttctttctttctttctttctttctttctttctttctttctttctttcttctttctttctttttctttcctcccttcctttatctctctctctctctctctttctctctttctttttgagatggagtttcactctcgctgcccaggctggagtacaatggtgcgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattagtttagagacagggtctcactccgtcgcctaggctggagtgcagtggtatgatcatggttcactgcaaccttaaactcctggcctcatatgatcctccggcctcagcctctcaaagtactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccagcctgggcaacatagtgagaccacatctctacaaaaaatttaaaaatgagccaggcatggtggtgcacacctgtagtctctgctattcaggaggctgaggcgggatcattgtttgagcccaggagacagattgcagtgagctatgatggcaccactgcatggcagcctgggtgacaaagggagactcagtctcaaaaaaaaccaaaagttacccagcaacccaagtcatatcctgatgatatccatactcctcagtcatgcatcccgtggtgcgggggctgaccccaagaggagctgctgcccccagagggtggggagccgaggcaggcctnggtcagacttaccaggctatgctcccagcccagccctcactagggacccccgagtgcatctctctcctctccaggcctctgtttctccatctgtgcaaccacagtgttggacatggtagtcccaagtgtctgctcgtaactttgccctctctgtgcccccaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggccc

SEQ ID NO: 364721 - DNA, 2857 bp, Homo sapiens
  misc_feature (2382)..(2382): n is a, c, g, or t
gccggaccggtgttccttcgtctctgtgtctggccaagtagccccaggtgacctctttttttttttttttttttgagatggagtcttgctctgtcgcccaggctggggtacaatggcacgatctcggctcactgcaatctccgcctcctgggttcaagtgattctcctgcctcagcctcccgagtagctgggactacaggtgtgcaccaccacgcctgggtaatctttgtatttttagtagagacggggtttcaccatgttggccaggctggtctcgaactcctgacctcaagtgatcctcccgcctcggcctcccaaagtgctgggattacagattacagctgtgagccaccgcacccggccgcattcttctaaatcacagtacatctggttcccagtgcccaggctctcagggcagagggtccagtgtgatcactttgcatggcctctctcccctcctgagcttgtgccagggccccagggctgacctggagaaggaaaatggcagagggtgaagatggggtgtctggtttggggaccatcctggccccccttgtcactgttggcatctcttctgcacagtggcattgctgggaggtgcttactgtgcctattcaaggggctggcagccgcagcctcactgcagatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgtggtggctcatgcctgtcaccccagcaccttgggaggccgaggtgggcagatcatatgaggtcaggactttgagaccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccagcctgactccgtctcaaaaaaaaaaaaaaaaaaggcatttcagttcaaatagggaaaggatacatctttctttctttctttctttctttctttctttctttctttctttctttctttctttctttcttctttctttctttttctttcctcccttcctttatctctctctctctctctctttctctctttctttttgagatggagtttcactctcgctgcccaggctggagtacaatggtgcgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattagtttagagacagggtctcactccgtcgcctaggctggagtgcagtggtatgatcatggttcactgcaaccttaaactcctggcctcatatgatcctccggcctcagcctctcaaagtactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccagcctgggcaacatagtgagaccacatctctacaaaaaatttaaaaatgagccaggcatggtggtgcacacctgtagtctctgctattcaggaggctgaggcgggatcattgtttgagcccaggagacagattgcagtgagctatgatggcaccactgcatggcagcctgggtgacaaagggagactcagtctcaaaaaaaaccaaaagttacccagcaacccaagtcatatcctgatgatatccatactcctcagtcatgcatcccgtggtgcgggggctgaccccaagaggagctgctgcccccagagggtggggagccgaggcaggcctnggtcagacttaccaggctatgctcccagcccagccctcactagggacccccgagtgcatctctctcctctccaggcctctgtttctccatctgtgcaaccacagtgttggacatggtagtcccaagtgtctgctcgtaactttgccctctctgtgcccccaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggccc

SEQ ID NO: 364722 - DNA, 3498 bp, Homo sapiens
  misc_feature (3023)..(3023): n is a, c, g, or t
ggagctgggattacaggcatgcgccaccacacctggctcacagggtgagaccctgtctctaaaaacaacaatgacaaaaatgacacaatagtgagggcacaggccccagtcactgacttagattctaatcccagctcttccaactgctgtttcttcacctgcggagcctcagtttccccatctgtcattggggataccagcccctgcttcacgggtgcctaggggattcccagattatggaggtgcctcaaggtgcccggtggggctgagggtggagggtatgggggttcagggccgggtccctggctgagctgaccccacaggtttcagcgggtgggcccacctgacggaggtcgaccccgacgaggaggtgcagggcgagatccacctgcggctggaagtgtggccaggggcccgggcctgccggctacgctgctctgtgctggaggccaggtgagactcaggggcctgggggcgggcagtgggtcccctgcaactagagaaacccaatgaggaagctgagccccccctcgccccacctctacctcctggtcccagagctggccacctcccatcaaagcctgctctcaagagagggtctcgccaggcacggcgtctcacacctgtaatcccagcactttgggaggccgaggcaggtggttcacctgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacagagcacgactccatctcaaaaacaaacaaaaaaaaaagagtgtcacctggggctacttggccagacacagagagcaaggagacatccctattatctgtcaaaaataattattacagctgtgagccaccgcacccggccgcattcttctaaatcacagtacatctggttcccagtgcccaggctctcagggcagagggtccagtgtgatcactttgcatggcctctctcccctcctgagcttgtgccagggccccagggctgacctggagaaggaaaatggcagagggtgaagatggggtgtctggtttggggaccatcctggccccccttgtcactgttggcatctcttctgcacagtggcattgctgggaggtgcttactgtgcctattcaaggggctggcagccgcagcctcactgcagatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgtggtggctcatgcctgtcaccccagcaccttgggaggccgaggtgggcagatcatatgaggtcaggactttgagaccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccagcctgactccgtctcaaaaaaaaaaaaaaaaaaggcatttcagttcaaatagggaaaggatacatctttctttctttctttctttctttctttctttctttctttctttctttctttctttctttcttctttctttctttttctttcctcccttcctttatctctctctctctctctctttctctctttctttttgagatggagtttcactctcgctgcccaggctggagtacaatggtgcgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattagtttagagacagggtctcactccgtcgcctaggctggagtgcagtggtatgatcatggttcactgcaaccttaaactcctggcctcatatgatcctccggcctcagcctctcaaagtactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccagcctgggcaacatagtgagaccacatctctacaaaaaatttaaaaatgagccaggcatggtggtgcacacctgtagtctctgctattcaggaggctgaggcgggatcattgtttgagcccaggagacagattgcagtgagctatgatggcaccactgcatggcagcctgggtgacaaagggagactcagtctcaaaaaaaaccaaaagttacccagcaacccaagtcatatcctgatgatatccatactcctcagtcatgcatcccgtggtgcgggggctgaccccaagaggagctgctgcccccagagggtggggagccgaggcaggcctnggtcagacttaccaggctatgctcccagcccagccctcactagggacccccgagtgcatctctctcctctccaggcctctgtttctccatctgtgcaaccacagtgttggacatggtagtcccaagtgtctgctcgtaactttgccctctctgtgcccccaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggccc

SEQ ID NO: 364723 - DNA, 3196 bp, Homo sapiens
  misc_feature (291)..(291): n is a, c, g, or t
  misc_feature (2785)..(2785): n is a, c, g, or t
  misc_feature (2868)..(2868): n is a, c, g, or t
  misc_feature (2888)..(2888): n is a, c, g, or t
  misc_feature (3104)..(3104): n is a, c, g, or t
  misc_feature (3145)..(3145): n is a, c, g, or t
  misc_feature (3161)..(3164): n is a, c, g, or t
  misc_feature (3171)..(3171): n is a, c, g, or t
tgtctggctaattttttaaatttctttagagacggggtctcactatgttgctcaggctgctgtaatcccagctactcaggaggctgaggcaggagaattacttgaacccaggaggcggaggttgcagtgagctaagattgcaccattgcactccagcctgggcaacagagcacgactccatctcaaaaacaaacaaaaaaaaagagtgtcacctggggctacttggccagacacagagagcaaggagacatccctattatctgtcaaaaataattgttggggctgagcacngtggctcatgcctgtaatctcagcactttgggaggtcggggcaggaggacttgaggcctagagtttgagaccagcctgggcaacatggcgaaaccccatctctactaaaaatacaaaaaattagccaggcatggtggtggatgcctgtaatcgcagctactcaggagagggcgctggagaatcacttgaactcatggtgcgcaggttgcagggagccaagatggcaccattgtgctccagcctgggcaacgagagcaaaactccatctcaaaaaaaataaagaacctgcgagtgagttcccacacgttttcctaatgggctgctgctttcctaggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatagtttgctctctctctcctagttaacaggctttcaaatattagaagatcaatgttctgaccccattaaaatttctcttttgtggaatgaaaagctctgatttaacccatcttcaaggctggtttgatggaggaataggggctgagtcacctgcatttcccctccctgcacaaagtcctgggcccagatctggggtctgtctctgctgagggtggggtgaaccaggaagcacctccttcttcatctccttgatgaatgggtataatggttgccatggaactggggcttgtttgatgacctggggctgggtgggcctctgagagcctttatagctgattgccttttgggagaggggaggtgggagccccaccctgtctcatgagtcaccccaaaggtgcatgggcaggcaggtgctggggaatcggctactccccagagcttggcgtggccatccctgtggcccctctgggagtctggagcccattccctcacgctggtactcactgcagctggggacatctgcactaggaagacaggacacggcatggaagctggcctctgcccagaagccatgacattctggtcaccagcctgatgctataaaacgagtgtcacggccgggcatggtggttcacacctgtaatcccagcactttgggaggccaaggcgggtggatcatgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacagagcacgactccatctcaaaaacaaacaaaaaaaaaagagtgtcacctggggctacttggccagacacagagagcaaggagacatccctattatctgtcaaaaataattattacagctgtgagccaccgcacccggccgcattcttctaaatcacagtacatctggttcccagtgcccaggctctcagggcagagggtccagtgtgatcactttgcatggcctctctcccctcctgagcttgtgccagggccccagggctgacctggagaaggaaaatggcagagggtgaagatggggtgtctggtttggggaccatcctggccccccttgtcactgttggcatctcttctgcacagtggcattgctgggaggtgcttactgtgcctattcaaggggctggcagccgcagcctcactgcagatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgtggtggctcatgcctgtcaccccagcaccttgggaggccgaggtgggcagatcatatgaggtcaggactttgagaccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccagcctgggagacagagcaagactctgtctccaaaacaaacaaacaaacnaaaaaaccctgtagcttgggatcagccttctcttctattgtttttctttaaaaaataaaaattaaaaatagatgtagatgctntgttgctgaggctggcctcnaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattnctgtgaaggtgagaaaagttcatttttattatgtttccccnagagacgcactctatnnnnctcttgnaaacgcacaactcttctaataaacg

SEQ ID NO: 364724 - DNA, 2383 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgaggtgcgccctccacccgctgggctaggctgggccgggttggactgggctggggcgaggggtgaagagcggtggggaaccagggagcgctggggaggaccagggaggctgtgtcgcagcgagggtcagggacggagcctaaggggagggggctgccaggagccctggtctgggggactccagcccgcgctcttccgcacccctccagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggtgcgggccttgcggccacgggcgggatgcacagctgggtgtcctaccggggccctggcctggactgcagagtgttccctaccggctccggcgaggccactggcacgcccacgtaggcactgcacttcacagtttgcaaagccttcctgtggccaccttgtccgagctccatctcatggataagggaacaggcctgcgaggggtcgggggttgccaaggccgcccatcctgtcggtggtgaatcgcgggaccttccaacccaggtctgcttactctcaggctgcacctatgtgcccggcaccggggtggggtatccagtgcagcagcgtcagttaaaccctcccatcatctgtgcctgttgacatttgctccatccttgagctccatagccccgccgccacctgctactgacgcgtgtcccgcctccaagcccatggccctgccttcctcagtccacctgtcaccccgctcaccaccagctgttgatgtttgctccgcccttgagccccatgactacgtccactgcctgctgttcagatttgctcagcccttgagccccatggcccctcccactgctccgctcccc

SEQ ID NO: 364725 - DNA, 2220 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacggtgagcgccgccctgcacagacccgcccacagcctactgctgacgtttgctccgcccttgagccccacggccccacccatcgctgtttgttcctctcgtggccccacccaccgcctgctgttggcatttgccaggcccccaggccatagacccacgcaccactgtttgtgcttcctgtgaccctgcccactgcctgctgttgacgtttgccccacccctagacccatggcctcaccctcccatcatctgtgcctgttgacatttgctccatccttgagctccatagccccgccgccacctgctactgacgcgtgtcccgcctccaagcccatggccctgccttcctcagtccacctgtcaccccgctcaccaccagctgttgatgtttgctccgcccttgagccccatgactacgtccactgcctgctgttcagatttgctcagcccttgagccccatggcccctcccactgctccgctcccc

SEQ ID NO: 364726 - DNA, 2410 bp, Homo sapiens
  misc_feature (291)..(291): n is a, c, g, or t
  misc_feature (1852)..(1852): n is a, c, g, or t
tgtctggctaattttttaaatttctttagagacggggtctcactatgttgctcaggctgctgtaatcccagctactcaggaggctgaggcaggagaattacttgaacccaggaggcggaggttgcagtgagctaagattgcaccattgcactccagcctgggcaacagagcacgactccatctcaaaaacaaacaaaaaaaaagagtgtcacctggggctacttggccagacacagagagcaaggagacatccctattatctgtcaaaaataattgttggggctgagcacngtggctcatgcctgtaatctcagcactttgggaggtcggggcaggaggacttgaggcctagagtttgagaccagcctgggcaacatggcgaaaccccatctctactaaaaatacaaaaaattagccaggcatggtggtggatgcctgtaatcgcagctactcaggagagggcgctggagaatcacttgaactcatggtgcgcaggttgcagggagccaagatggcaccattgtgctccagcctgggcaacgagagcaaaactccatctcaaaaaaaataaagaacctgcgagtgagttcccacacgttttcctaatgggctgctgctttcctaggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatagtttgctctctctctcctagttaacaggctttcaaatattagaagatcaatgttctgaccccattaaaatttctcttttgtggaatgaaaagctctgatttaacccatcttcaaggctggtttgatggaggaataggggctgagtcacctgcatttcccctccctgcacaaagtcctgggcccagatctggggtctgtctctgctgagggtggggtgaaccaggaagcacctccttcttcatctccttgatgaatgggtataatggttgccatggaactggggcttgtttgatgacctggggctgggtgggcctctgagagcctttatagctgattgccttttgggagaggggaggtgggagccccaccctgtctcatgagtcaccccaaaggtgcatgggcaggcaggtgctggggaatcggctactccccagagcttggcgtggccatccctgtggcccctctgggagtctggagcccattccctcacgctggtactcactgcagctggggacatctgcactaggaagacaggacacggcatggaagctggcctctgcccagaagccatgacattctggtcaccagcctgatgctataaaacgagtgtcacggccgggcatggtggttcacacctgtaatcccagcactttgggaggccaaggcgggtggatcatgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacaagagcaaaactccgtctcaaaataaatacatacatacatacatgcatacatacatacagggattaaaatagtctagtactgacacctgaacagacagattgatccaagaaatgaaacagaaattccagaagttgacctctgtctcacaaccacacaaccacaccacacgacaccacgaaaaaaaaaaaaaanaaaaaaaaaaaaaaaaaaaaaaaaaaaaaaaaaaaaaaaaaaaaaaaaaaaaaaaaaaaaaagggggggggggccacaacaaaaaatcatcctcccgcgaaggggcgcgccgcaacactaaagcaacgcacgcacccccacgatgttagtagaaaccagggcggcgccccatagtcgggaggagcagctaatatataaaaaaccggagggacggcggcggcgccgagggaaaaacacaacgacccgggagaggcgggagaagaacaaagacggagcaggtggagaaaaattttatgagagagagaacacatcttattatgggcgggggagcaggacaaaaatataggtgggggaagaaatcacttcctgaaaggtaagataatttaagagccgccgctgagggggcagggaataatatataccaaaggacgacgagggacgtatatgtggggtgtggaaaaaacaacgcgacgcgattagaattcggtcgatgtgcaggagagaacgatgttggtgcacatacaaggggtatttagattatgtacgaacgaatatacg

SEQ ID NO: 364727 - DNA, 2000 bp, Homo sapiens
  misc_feature (291)..(291): n is a, c, g, or t
tgtctggctaattttttaaatttctttagagacggggtctcactatgttgctcaggctgctgtaatcccagctactcaggaggctgaggcaggagaattacttgaacccaggaggcggaggttgcagtgagctaagattgcaccattgcactccagcctgggcaacagagcacgactccatctcaaaaacaaacaaaaaaaaagagtgtcacctggggctacttggccagacacagagagcaaggagacatccctattatctgtcaaaaataattgttggggctgagcacngtggctcatgcctgtaatctcagcactttgggaggtcggggcaggaggacttgaggcctagagtttgagaccagcctgggcaacatggcgaaaccccatctctactaaaaatacaaaaaattagccaggcatggtggtggatgcctgtaatcgcagctactcaggagagggcgctggagaatcacttgaactcatggtgcgcaggttgcagggagccaagatggcaccattgtgctccagcctgggcaacgagagcaaaactccatctcaaaaaaaataaagaacctgcgagtgagttcccacacgttttcctaatgggctgctgctttcctaggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatagtttgctctctctctcctagttaacaggctttcaaatattagaagatcaatgttctgaccccattaaaatttctcttttgtggaatgaaaagctctgatttaacccatcttcaaggctggtttgatggaggaataggggctgagtcacctgcatttcccctccctgcacaaagtcctgggcccagatctggggtctgtctctgctgagggtggggtgaaccaggaagcacctccttcttcatctccttgatgaatgggtataatggttgccatggaactggggcttgtttgatgacctggggctgggtgggcctctgagagcctttatagctgattgccttttgggagaggggaggtgggagccccaccctgtctcatgagtcaccccaaaggtgcatgggcaggcaggtgctggggaatcggctactccccagagcttggcgtggccatccctgtggcccctctgggagtctggagcccattccctcacgctggtactcactgcagctggggacatctgcactaggaagacaggacacggcatggaagctggcctctgcccagaagccatgacattctggtcaccagcctgatgctataaaacgagtgtcacggccgggcatggtggttcacacctgtaatcccagcactttgggaggccaaggcgggtggatcatgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacaagagcaaaactccgtctcaaaataaatacatacatacatacatgcatacatacatacagggattaaaatagtctagtactgacacctgaacagacagattgatccaagaaatgaaacagaaattccagaagttgacctgaacacacacacacacacacacacacacacacacacacacacacacacacgaaggcgtgaaagactccatgaccctcaaggtataagatgcatttttttttttttttgagacagggtctcactctgtcacccagactggatgcagtggtgcactatcccagctcagttctaccctccatccccccaacctcccccaaccacc

SEQ ID NO: 364728 - DNA, 672 bp, Homo sapiens
  misc_feature (25)..(25): n is a, c, g, or t
gtgactccagaggatcccgcaggcnatccggttcaatattcaaaatgcgatctagagccgggagtgggggtgcagtggctcacgcctgtaatcccagcactttgggaggcagaggcgggcggatgacttgaggtcaggagttctcaaccagcctggccaaaatggtgaaaccccatctctactaaaaacacaaaaattaaccaggcgtggtggtgggcacctgtaatcctagctacttgggaggctgaggcaggagaatgaatcgcttgaacccaggaggtggaggttgcagtgagccgagaccacaccattgcactctagcctgggcaacaagagcaaaactccgtctcaaaataaatacatacatacatacatgcatacatacatacagggattaaaatagtctagtactgacacctgaacagacagattgatccaagaaatgaaacagaaattccagaagttgacctgaacacacacacacacacacacacacacacacacacacacacacacacacgaaggcgtgaaagactccatgaccctcaaggtataagatgcatttttttttttttttgagacagggtctcactctgtcacccagactggatgcagtggtgcactatcccagctcagttctaccctccatccccccaacctcccccaaccacc

SEQ ID NO: 364729 - DNA, 723 bp, Homo sapiens
  misc_feature (208)..(208): n is a, c, g, or t
atctagcaggatccttagtcatagcgtatttcagccgcggcggcttcccctcctggcaataccaacgcatacatttcttcctggctctgtgagtggtttgctgcctcctatccgtcaatatcaatgcctgggacagcgggggaagtgggatccagccttcatttattctttcactattgtcctctttactctgtgtacaaaaaagagnggatatactatcatagactgttgtttctaaacagaaactcaggctgggcacagtggaatacgcctgtaatcctagctacttgggaggctgaggcaggagaatgaatcgcttgaacccaggaggtggaggttgcagtgagccgagaccacaccattgcactctagcctgggcaacaagagcaaaactccgtctcaaaataaatacatacatacatacatgcatacatacatacagggattaaaatagtctagtactgacacctgaacagacagattgatccaagaaatgaaacagaaattccagaagttgacctgaacacacacacacacacacacacacacacacacacacacacacacacacgaaggcgtgaaagactccatgaccctcaaggtataagatgcatttttttttttttttgagacagggtctcactctgtcacccagactggatgcagtggtgcactatcccagctcagttctaccctccatccccccaacctcccccaaccacc

SEQ ID NO: 364730 - DNA, 1108 bp, Homo sapiens
ggagctgggattacaggcatgcgccaccacacctggctcacagggtgagaccctgtctctaaaaacaacaatgacaaaaatgacacaatagtgagggcacaggccccagtcactgacttagattctaatcccagctcttccaactgctgtttcttcacctgcggagcctcagtttccccatctgtcattggggataccagcccctgcttcacgggtgcctaggggattcccagattatggaggtgcctcaaggtgcccggtggggctgagggtggagggtatgggggttcagggccgggtccctggctgagctgaccccacaggtttcagcgggtgggcccacctgacggaggtcgaccccgacgaggaggtgcagggcgagatccacctgcggctggaagtgtggccaggggcccgggcctgccggctacgctgctctgtgctggaggccaggtgagactcaggggcctgggggcgggcagtgggtcccctgcaactagagaaacccaatgaggaagctgagccccccctcgccccacctctacctcctggtcccagagctggccacctcccatcaaagcctgctctcaagagagggtctcgccaggcacggcgtctcacacctgtaatcccagcactttgggaggccgaggcaggtggttcacctgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacagagcacgactccatctcaaaaacaaacaaaaaaaaaagagtgtcacctggggctacttggccagacacagagagcaaggagacatccctattatctgtcaaaaataattgttggggctgagcacagtggctcatgcctataatctcagcactttgggaggtcggggcaggaggacttgaggcctagagtttgagaccagcctgggcaacatagcgagcaccccatctccagaaaaaatttaa

SEQ ID NO: 364731 - DNA, 788 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggtaccgcccccacccccaggaccgaggggcgctcagcctctcatcggcccgcgctctccccgcaaaggggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtaagttctcccttccctcccatactggtctgcccagtccctgcctccctcccactcggagacctcccctctaggctccgtctggtctcctgctcagggaaagccatttctactctccccagaagccggggccacgttctgtactcctggcctctgttctgcagcatgttcccaagcctggttgttactgcctcttccctagggtgaagaggggctgctatgggtggaatctgaggcctctgctggcagaagaaggggcctccttacactctattgctgaagcatagggaccccttctccaaatcaggccagctccttctgtaacccatggggtcgcctccatc

SEQ ID NO: 364732 - DNA, 422 bp, Homo sapiens
cccgtcagaggcgtttagtgaatctggaactttgagttgcagtgagccgagaccacaccattgcactctagcctgggcaacaagagcaaaactccgtctcaaaataaatacatacatacatacatgcatacatacatacagggattaaaatagtctagtactgacacctgaacagacagattgatccaagaaatgaaacagaaattccagaagttgacctgaacacacacacacacacacacacacacacacacacacacacacacacacgaaggcgtgaaagactccatgaccctcaaggtataagatgcatttttttttttttttgagacagggtctcactctgtcacccagactggatgcagtggtgcactatcccagctcagttctaccctccatccccccaacctcccccaaccacc

SEQ ID NO: 364733 - DNA, 5609 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364734 - DNA, 3290 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtcaaaaaaaaaaaaactgaccccctgaaggtgtacccgccactgaaggggagcttcccggagaacctgagacaccttaagaacaccatggagaccatagactggaaggtctttgagagttggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagccccttcgtgcc

SEQ ID NO: 364735 - DNA, 5808 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggtaccgcccccacccccaggaccgaggggcgctcagcctctcatcggcccgcgctctccccgcaaaggggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagcgctccaaacagggaaacc

SEQ ID NO: 364736 - DNA, 5507 bp, Homo sapiens
ctcccacccctgcccgcgaaaggggagccctggtgcgggttcctgcccttccctcaccatccgctcccgggctgagggcggggacccgtgtttggccggaggagcctgcggtctccaaaccaggacgcggagactcagcctccgctctcttcccccgcactcctcccgaggggccaaaagagagaggagcctgccgcgagtccccgccccgatcccgccctccagccccgcccctgcctatttgtcttgcagcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaaggatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364737 - DNA, 5056 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggtaccgcccccacccccaggaccgaggggcgctcagcctctcatcggcccgcgctctccccgcaaaggggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaacatggcaaaacctagtcccctacaaattaaaaaaaacaaaaacaaacaaaacaacacaaaacggggacaacatacaacggcgagaactctcgcaaattttgtgcgacaccctaacaatgcggcgcggagcaggggcatccaccctgtggtggcacgcgtgtctcttttatcacaccccccgtggcgtttaacaccccttcacaagcgtggggtctaccagcgtgggaacaacctgtagcgtgtgtgttttcacatccccccctattttctctcaccctcccccatacaacacagggctctttaccacaaacagctaacaagatcttctttaagagggggcgccaccttacgccgcgcaccccccccaatagtgggtgcaccaccacacaacccacatagtgtggtcttagcagacaaaaagcgacactccctttagtagagagacaccgaccaacgtgtgcgacaaaacttctttcgaaaccaccactgtggcttccaactccctaaatcagggaaacgaagtgggggcgacttattatcacaaatttttcacacagccggttcgtggcactcaaaagaaaataacgggccacatgggcg

SEQ ID NO: 364738 - DNA, 6152 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgaggtgcgccctccacccgctgggctaggctgggccgggttggactgggctggggcgaggggtgaagagcggtggggaaccagggagcgctggggaggaccagggaggctgtgtcgcagcgagggtcagggacggagcctaaggggagggggctgccaggagccctggtctgggggactccagcccgcgctcttccgcacccctccagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggtgcgggccttgcggccacgggcgggatgcacagctgggtgtcctaccggggccctggcctggactgcagagtgttccctaccggctccggcgaggccactggcacgcccacgtaggcactgcacttcacagtttgcaaagccttcctgtggccaccttgtccgagctccatctcatggataagggaacaggcctgcgaggggtcgggggttgccaaggccgcccatcctgtcggtggtgaatcgcgggaccttccaacccaggtctgcttactctcaggctgcacctatgtgcccggcaccggggtggggtatccagtgcagcagcgtcagttaaacgcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364739 - DNA, 3006 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggtaccgcccccacccccaggaccgaggggcgctcagcctctcatcggcccgcgctctccccgcaaaggggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtc

SEQ ID NO: 364740 - DNA, 3401 bp, Homo sapiens
ccaacaacctcaagtctcttgaggctcaggcggagaagtactctcaaaaagaagataaatatgaggaagaaatcaagattcttactgataaaccggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagtttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagt

SEQ ID NO: 364741 - DNA, 2860 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggggccctcagcacggcaccctgagcttcggccccggcaaacaggactccggtctgcgctttccagagggtcgatctccct

SEQ ID NO: 364742 - DNA, 2722 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggggccctcagcacggcaccctgagcttcggccccggcaaacaggactccggtctgcgctttccagagggtcgatctccct

SEQ ID NO: 364743 - DNA, 2707 bp, Homo sapiens
  misc_feature (2232)..(2232): n is a, c, g, or t
aacttaggctaggtacgaggcctggtttgaatcggccgagggcacggtgtaatgcttctgcagttgatcacaacagagcacgactccatctcaaaaacaaacaaaaaaaaaagagtgtcacctggggctacttggccagacacagagagcaaggagacatccctattatctgtcaaaaataattattacagctgtgagccaccgcacccggccgcattcttctaaatcacagtacatctggttcccagtgcccaggctctcagggcagagggtccagtgtgatcactttgcatggcctctctcccctcctgagcttgtgccagggccccagggctgacctggagaaggaaaatggcagagggtgaagatggggtgtctggtttggggaccatcctggccccccttgtcactgttggcatctcttctgcacagtggcattgctgggaggtgcttactgtgcctattcaaggggctggcagccgcagcctcactgcagatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgtggtggctcatgcctgtcaccccagcaccttgggaggccgaggtgggcagatcatatgaggtcaggactttgagaccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccagcctgactccgtctcaaaaaaaaaaaaaaaaaaggcatttcagttcaaatagggaaaggatacatctttctttctttctttctttctttctttctttctttctttctttctttctttctttctttcttctttctttctttttctttcctcccttcctttatctctctctctctctctctttctctctttctttttgagatggagtttcactctcgctgcccaggctggagtacaatggtgcgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattagtttagagacagggtctcactccgtcgcctaggctggagtgcagtggtatgatcatggttcactgcaaccttaaactcctggcctcatatgatcctccggcctcagcctctcaaagtactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccagcctgggcaacatagtgagaccacatctctacaaaaaatttaaaaatgagccaggcatggtggtgcacacctgtagtctctgctattcaggaggctgaggcgggatcattgtttgagcccaggagacagattgcagtgagctatgatggcaccactgcatggcagcctgggtgacaaagggagactcagtctcaaaaaaaaccaaaagttacccagcaacccaagtcatatcctgatgatatccatactcctcagtcatgcatcccgtggtgcgggggctgaccccaagaggagctgctgcccccagagggtggggagccgaggcaggcctnggtcagacttaccaggctatgctcccagcccagccctcactagggacccccgagtgcatctctctcctctccaggcctctgtttctccatctgtgcaaccacagtgttggacatggtagtcccaagtgtctgctcgtaactttgccctctctgtgcccccaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggccc

SEQ ID NO: 364744 - DNA, 2763 bp, Homo sapiens
  misc_feature (1)..(1): n is a, c, g, or t
  misc_feature (4)..(4): n is a, c, g, or t
  misc_feature (6)..(6): n is a, c, g, or t
ngcngngcccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgaggtgcgccctccacccgctgggctaggctgggccgggttggactgggctggggcgaggggtgaagagcggtggggaaccagggagcgctggggaggaccagggaggctgtgtcgcagcgagggtcagggacggagcctaaggggagggggctgccaggagccctggtctgggggactccagcccgcgctcttccgcacccctccagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggtgcgggccttgcggccacgggcgggatgcacagctgggtgtcctaccggggccctggcctggactgcagagtgttccctaccggctccggcgaggccactggcacgcccacgtaggcactgcacttcacagtttgcaaagccttcctgtggccaccttgtccgagctccatctcatggataagggaacaggcctgcgaggggtcgggggttgccaaggccgcccatcctgtcggtggtgaatcgcgggaccttccaacccaggtctgcttactctcaggctgcacctatgtgcccggcaccggggtggggtatccagtgcagcagcgtcagttaaacgcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacggtgagcgccgccctgcacagacccgcccacagcctactgctgacgtttgctccgcccttgagccccacggccccacccatcgctgtttgttcctctcgtggccccacccaccgcctgctgttggcatttgccaggcccccaggccatagacccacgcaccactgtttgtgcttcctgtgaccctgcccactgcctgctgttgacgtttgccccacccctagacccatggcctcaccctcccatcatctgtgcctgttgacatttgctccatccttgagctccatagccccgccgccacctgctactgacgcgtgtcccgcctccaagcccatggccctgccttcctcagtccacctgtcaccccgctcaccaccagctgttgatgtttgctccgcccttgagccccatgactacgtccactgcctgctgttcagatttgctcagcccttgagccccatggcccctcccactgctccgctcccc

SEQ ID NO: 364745 - DNA, 2251 bp, Homo sapiens
  misc_feature (1776)..(1776): n is a, c, g, or t
gctactactactactactactaccaaattcgcggcgctcgatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgtggtggctcatgcctgtcaccccagcaccttgggaggccgaggtgggcagatcatatgaggtcaggactttgagaccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccagcctgactccgtctcaaaaaaaaaaaaaaaaaaggcatttcagttcaaatagggaaaggatacatctttctttctttctttctttctttctttctttctttctttctttctttctttctttctttcttctttctttctttttctttcctcccttcctttatctctctctctctctctctttctctctttctttttgagatggagtttcactctcgctgcccaggctggagtacaatggtgcgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattagtttagagacagggtctcactccgtcgcctaggctggagtgcagtggtatgatcatggttcactgcaaccttaaactcctggcctcatatgatcctccggcctcagcctctcaaagtactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccagcctgggcaacatagtgagaccacatctctacaaaaaatttaaaaatgagccaggcatggtggtgcacacctgtagtctctgctattcaggaggctgaggcgggatcattgtttgagcccaggagacagattgcagtgagctatgatggcaccactgcatggcagcctgggtgacaaagggagactcagtctcaaaaaaaaccaaaagttacccagcaacccaagtcatatcctgatgatatccatactcctcagtcatgcatcccgtggtgcgggggctgaccccaagaggagctgctgcccccagagggtggggagccgaggcaggcctnggtcagacttaccaggctatgctcccagcccagccctcactagggacccccgagtgcatctctctcctctccaggcctctgtttctccatctgtgcaaccacagtgttggacatggtagtcccaagtgtctgctcgtaactttgccctctctgtgcccccaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggccc

SEQ ID NO: 364746 - DNA, 3039 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364747 - DNA, 3612 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagaaaaaaaaaaaaaaaaaaaaaaaaaaaaaaaaaaaaaagaacaagaaaaaaaaaacaaaaaaagaggagggggggcgcagagacagccacctcccaggagggagccaaaacaggcgacagcgcacactgtaatagcaaaaaggcgggaccacacacgaggcgagagtaataaaaaaagccgaagagccgcggagcgagagacaaaccacaggagcggcgaagcggagcaacaaagccgaggagccagcggcgacgagcccgaagagatcagaaaggacaccacgcagcgaggagaggaagagaaaaaagacagagggggcagaacaaacagcgaaaccagagccggagagacacgagagaagcacaggcaggaggacgaagaaggagaaacaacaaaacacaaacagcagaagagcaacaagcgaagcaccgaggggagagagcacacacagaccggagagcgacaacgccaacacacgagaacgcgacacacgagcaagacacacgaagcgagcgctgaacaaagagcaaggccgcgcctaagcaccgaaggagccaccggacagaagaccagctagcccacaaaccaacagccagaacgaagacgcggtgcacgacgaaacacagaacaagagcaccaggagagatcaacagcagaagagggcaaggatcgacaggcggaagcgacggaaagcagagacagagacaccacagcccaaggacgcgagcaggcgcccagctcggaaagagcgaggcaggagagagccagagcccccacgcgaaagaggcgagagcaggcgagcaaaagaaggaaggcactgaaacacaagacagagcagagacacgagcagagagacgatgggaaccacaaggagtagcaagccgagagcagacacaggagagaaacacgca

SEQ ID NO: 364748 - DNA, 3513 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagaaaaaaaaaaaaaaaaaaaaaaaaaaaaaatttttgggggcctcgcgaaaaagttttataaacccaatcggttgtgggggcgagggccccagagtaggtaacagtgtgaccacgtgccccaacgcgctgtcccaaagcgaaacccggggacagaaacataggggctggggcttctcccacccaaataaaaaaacggcccgggaggaaccacagacgtgttctggaacaaaaccacagaagggaagatcgacggaggcaacaaaccgggacacatacaaaacggggagtctcacaagcagaacgcggattataaaaatttagccccgccagtggaggaaaagaacagcaaccacacacaaagaagaaagaaagcaagcaaaagcaaaacccagaagagcaacagcagagagagaagaacacgaaaacagacgacacgaccgcaagaggaagcacaacaatgacggcaagcagagaagccgagaacgaacacgagaaaagaagacggaacaagagcaatacaggaacaagaaccgaagcaatacagcgaaagacgcgagacggagcgagcgaggaggggagagacgacgagagggaaagagcagagcgagggggaggggagggagcagagagagcggcgaggacgaaagaacagaagaggacagggcgccgcaagggaagggagaggagcgcagaggcgagagggaggaaaaagcgggggagacgaaaagagaagggggaaggagagagaagagcagagaagaaaggagagagggaccaagaacggaggaggagagagggaaaagggagagcgac

SEQ ID NO: 364749 - DNA, 3167 bp, Homo sapiens
gacttagatgagagaggtctccccagcaggaagggagggtctggtggttggcacccactagatgagcatggtcagaaaaatatcaggatgagcaacttctttatctaggcctgggtgggggtgcctggcacaggtctccatgggacatgctgcagctggtagcccccagaccccggggctgtgcccccctgggcggcacccagaagcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364750 - DNA, 4744 bp, Homo sapiens
  misc_feature (62)..(62): n is a, c, g, or t
  misc_feature (498)..(498): n is a, c, g, or t
  misc_feature (715)..(715): n is a, c, g, or t
  misc_feature (728)..(728): n is a, c, g, or t
gtgcccatggaagggacaaggctctcgtgcagagagtccatggaagggacaaggctctctgnacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccncagccctggccgtgcagaggtggagcgcctcttcgggcaagagcgcaggaagtccgaggcagcgggggccttccaggcccaggacgagggacggtcacagcagcccagccaaggccagagccaacttctccgaagacagtccagccctgcccccagcaggcaggtgaccatgctccctgccaaacaggcagaactgacccggcggagccaagcaganccccctcatcctnggagtcctgagaagagacctgagggagatcggcagctccaggggtccccgctgccccccaggacatcagccaggacccctgagagggagctgcggacacagagacctctggagagtggccaagcaggcccaagacagcctctgggggtgtggcagagtcaggaggaaccgccagggtcccagggccctcatagacacctagaaaggagctggagcagccaggagggaggcctgggccctgggggctggtggggatgtggagagcccagcctgggggcagccaaagccccggagggagcatgggggggcacttccagggagtacaaggagagctgggggcagccagaggcctgggaggagaagcccactcatgagctccccagagaactaggaaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcagttccaaccagaggagcctgaggagtcagaaccaagcagaggccaagaccccctgactgaccagaagcaggcagactcgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364751 - DNA, 3111 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364752 - DNA, 3078 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcaacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364753 - DNA, 2071 bp, Homo sapiens
gcgagaactccatctctgcagagctgcgctcacatgcctcctgtgagatgtagcccggggggatgtggccatcctcctgggatctcagtgcactctgaggagcctccccttggagacgccacgcctccggctgggcccgaagagcatgaacctccttctccagtgcctcctcctgctgctggcgctgcagctaccgctcgtggtgccgctgcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364754 - DNA, 1741 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgagtgtcctcactagcaccaggc

SEQ ID NO: 364755 - DNA, 1301 bp, Homo sapiens
gtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacgtgcacttgccacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364756 - DNA, 1146 bp, Homo sapiens
gcggccgcctactactactaaattcgcggccgcgtcgacctggatggaagtaaaaagccaagctttctccccaccctctgtgggccacacgtgcacttgcacccaccacacacacacaacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364757 - DNA, 985 bp, Homo sapiens
gcggccgcctactactactactactgctcgaattcaagcttctaacgatgtacggggacatggccccacagcctccttcgaggctgtgctgggtgcagaaccgccagagccacccaaaaggtgtttctcttctgctccctgaacctcttaacttaataaaacgttccagcagaaaaaaaaaaaaaaaaaaaaaaaaaaaaaatttttgggggcctcgcgaaaaagttttataaacccaatcggttgtgggggcgagggccccagagtaggtaacagtgtgaccacgtgccccaacgcgctgtcccaaagcgaaacccggggacagaaacataggggctggggcttctcccacccaaataaaaaaacggcccgggaggaaccacagacgtgttctggaacaaaaccacagaagggaagatcgacggaggcaacaaaccgggacacatacaaaacggggagtctcacaagcagaacgcggattataaaaatttagccccgccagtggaggaaaagaacagcaaccacacacaaagaagaaagaaagcaagcaaaagcaaaacccagaagagcaacagcagagagagaagaacacgaaaacagacgacacgaccgcaagaggaagcacaacaatgacggcaagcagagaagccgagaacgaacacgagaaaagaagacggaacaagagcaatacaggaacaagaaccgaagcaatacagcgaaagacgcgagacggagcgagcgaggaggggagagacgacgagagggaaagagcagagcgagggggaggggagggagcagagagagcggcgaggacgaaagaacagaagaggacagggcgccgcaagggaagggagaggagcgcagaggcgagagggaggaaaaagcgggggagacgaaaagagaagggggaaggagagagaagagcagagaagaaaggagagagggaccaagaacggaggaggagagagggaaaagggagagcgac

SEQ ID NO: 364758 - DNA, 272 bp, Homo sapiens
catggacagatgatagaatggatggatgaggtggacagatgcatgcatcctggagaataagttgggctaagctgtgttctttttttaatctccagttccaaccagaggagcctgaggagtcagaaccaagcagaggccaagaccccctgactgaccagaagcaggcagactcggtagctgggtcatgggtgtgggtacatacggtggggaagggagggggaagcaggttggagatgggcttcattcctcagaagagccctagaatcaaccag

SEQ ID NO: 364759 - DNA, 3150 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364760 - DNA, 4882 bp, Homo sapiens
  misc_feature (62)..(62): n is a, c, g, or t
  misc_feature (498)..(498): n is a, c, g, or t
  misc_feature (715)..(715): n is a, c, g, or t
  misc_feature (728)..(728): n is a, c, g, or t
gtgcccatggaagggacaaggctctcgtgcagagagtccatggaagggacaaggctctctgnacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccncagccctggccgtgcagaggtggagcgcctcttcgggcaagagcgcaggaagtccgaggcagcgggggccttccaggcccaggacgagggacggtcacagcagcccagccaaggccagagccaacttctccgaagacagtccagccctgcccccagcaggcaggtgaccatgctccctgccaaacaggcagaactgacccggcggagccaagcaganccccctcatcctnggagtcctgagaagagacctgagggagatcggcagctccaggggtccccgctgccccccaggacatcagccaggacccctgagagggagctgcggacacagagacctctggagagtggccaagcaggcccaagacagcctctgggggtgtggcagagtcaggaggaaccgccagggtcccagggccctcatagacacctagaaaggagctggagcagccaggagggaggcctgggccctgggggctggtggggatgtggagagcccagcctgggggcagccaaagccccggagggagcatgggggggcacttccagggagtacaaggagagctgggggcagccagaggcctgggaggagaagcccactcatgagctccccagagaactaggaaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcagttccaaccagaggagcctgaggagtcagaaccaagcagaggccaagaccccctgactgaccagaagcaggcagactcggcagacaagaggccagcagagggcaaggctgggagcccgctcaagggccgactggtgacctcatggcggatgcccggggaccggcccacgctgttcaatccgttcctgctgtctctgggggtcctcaggtggcgaaggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364761 - DNA, 3241 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgaggtatacagggaggggctgggatgccaacctactgggtcccccgactgtggctgtggaaggttctggatcttcagctgtcccaagccccgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364762 - DNA, 4169 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtggatgccgaggcgtgtgccctgcagggtgggcaggggctgaggctctcccacacccgggactccctggaccaccccagccaggccacttccttcttctggcctccaattcccgttctgtaaaaaggacaatgaaaccagcaacacggggttgttgcagagatcccatcagacccgggccacaggctgcttcatcagcttaagcctgttcctccagagctgggcggcacagtgcagagccacagcctgctcagtgcaccccccttcttggggctggaggcaaatgcagcgtgcacatccctgacccccacagtgaatctccactgagcttcacacacacacatcgcacgctgaggccgggcttctatcccagttagtcttaacactccttcttgacttagcagggctcaaagtggttggttggttggttggttggttggttggttggttggttggttggttttggttgctttgagaaaggtcttactctgacacccaggctggagtgcagtggtgcaatcacggctcactgcagcctcaacctcctaggctcaagggatcctcccacctcagccttctgagtagctgggaccacaggccctcaccaccatgcccagataatttttgcactttttgtataggtggggtttcgccgtgatttcccaggctggtctcgaactcctgggctcaagcaatacacctgcctcagcctcccaaaattctgagattacaggtgtgagccgctgcacctggccaaagtgttcttatttttgctttttcaacgccacatctacctggagcatcctctttctgataagtcctcatggacttcctatggcatgcaggagaggccaccctatggctgagctgcttgggaaggagccaggaagagcggatctggctgtaccttaggggctgagaggtggtggaaggacccactcagcacccttgcttggccttggggtggcctcgcagcccctcagcccaggcctccagccctgccgcaccttgtctttcaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364763 - DNA, 3347 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtggatgccgaggcgtgtgccctgcagggtgggcaggggctgaggctctcccacacccgggactccctggaccaccccagccaggccacttccttcttctggcctccaattcccgttctgtaaaaaggacaatgaaaccagcaacacggggttgttgcagagatcccatcagacccgggccacaggctgcttcatcagcttaagcctgttcctccagagctgggcggcacagtgcagagccacagcctgctcagtgcaccccccttcttggggctggaggcaaatgcagcgtgcacatccctgacccccacagtgaatctccactgagcttcacacacacacacacacacagacacacagacacatacgcacacacgtgcacacatgtacacacggatacacacacacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccag

SEQ ID NO: 364764 - DNA, 2749 bp, Homo sapiens
agttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacagctggtgggcgtgatcactgtgcccgttttacagacaaggccactgagctctgagaggttatgtgacttgcccaaggtcaccccgcctgcaggtctcaaaggtgggatttgagcgagggtccggctgactgcagagcctgtgtgtgagtccccgtgtgacactctgcacttggacccttgccccggggaagtggggggctagtggccccgagagtcactccctgaacacagggaaatcctgccgaggcccactgggccaaggccccacacaaggaggtctgcaggacaggggagcctccagtagccctcagagaatgcaccgtccgcctaggacagcggttctcaacggggtccattttgtcccccttggggacatttggctgtgtctgggaatacttctggttgtcacaactaggacaaactaactctctagaaaaaacgtgtgtgtgtacacatatataagtttattataaattttaccaataaaaacaatgcttagtacacaatttacaaataaaaatatataattttattgtgaattccgtacagcaaatggatttttctcagaatgctttcagtgattttttccatactcttgtatccacaactgattaacaaagggggttgttctaacatgtgtgctggttgacatttttgtttatggtaatgagtaagatgagaagacatttgtcgaaactttactggtccatgttgtcagctacttctttgctagatcggatagtagttttctattgagaatatttgagaatattctattaagaatatttttgcaattttttgttctatttacaatgtaatggttatagatgtgagatacttctaagtttaatctgcattattagcattttcttatcacttgcttaagtctagacaatcaacaaaacaataaatcaagccctgatgtgtaatgtttaccaattctgcagtgtaaatactcccgctgtggccaatgctgcattaccagcacaaagtccctggacagagagttgggaagagatgtcacactattcactaggatttccaccatgcggatacagtagatgtgattggccccaagagcacgcataatacaacacagtgaaatatttaggaagtaataaatttgagtatctattgccttgtctttaacatagttaatttaaagtatataaatttaattgttaatggctgtgcttaacaactacatcacagaattactaaaaatttgacaatcagctgtctgtagttatcacaccattatctaaagtagaaaagaaggggccaggcgcagtggctcacgcctgtaatcccagcactttggggaggccgaagtgggcagatcacgaggtcaggagaacgagactaacctggccaacatggtgaaactccgtctctaataaaatacaaaaaatagccgggcgtggtggtgcgcactgtggtcccagctacttgggaggctgaggcaggggacccactggaacccaggaggcgcaggttgcagtgagccgagattgcgccacggcactccagcctggcgacagagtaagactccatctcaa

SEQ ID NO: 364765 - DNA, 182 bp, Homo sapiens
gtgctgcttcgcgtaaaagaaaacgaactccagtacctaaagaaggaggtgcagtgcctccgggacgagctccagatgatgcagaaggtaggtccttccgctgggctgggggccgtcggggactctggagccatctggatgccatcctgtgagcacctgctctgtgccaagccctccactcg

SEQ ID NO: 364766 - DNA, 1494 bp, Homo sapiens
cttttaaattgctgtattatgtaggtatctgaaaatccaaagaacgaatctcatatatgggtaaggaaatatatgggaaaggaaaaaaattgtgtacataagctgtctgtggcatagatcaagcctgtggcattctgtggccttcaaagagagaaggggagagagattctataagcttatcaggtagatttgtcattggaactttaggattttaaaattttggttaaaatatgtgaatactgttacttcagttaaagtaactccttttatagattttgctttctaacaaagtcagtgaaaagtaaccgaggttcactccagaaacatgtaaagaaagtaaaattattaaaaggccaaatatttaattcttgtgacattgaatctgcttttattataaagagttaagaaattgccatttccatgacagtttcctccatcaacaatcttaatattgaagcttgaatttaggtctgctggtcagtgattctagtctagcaaattactttaggactgaaagctcttgtttctttagaaaaatatactatggagattaggatcctgtttactagtgaagactctgtctcttttccaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccactccttggtgtggtggtcttgctggttcgtgttgggaagtagtatggcagcaatgcacaaattcagaatagccaagaaatccctccttttcaacgctctgtgcctgggaaccattagaggagttttaaaaaccatccctcatagcccacaattttgggtcaactctcaaaattgggaataagaaaactggcactgttgggagaaaaatcgttcttactgaaacatgaactggctcaggcaagcaaatagcgggagtcggcacaggaaggagtgtgtgctgcggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364767 - DNA, 872 bp, Homo sapiens
ttttatgtacgtttggcttggggatgaaaattctaattctagagtgtaggtaataccctattacagagtagataacgcatatcgcattcttaaggagcgaaaataattttgataatggtcttggtatatagattgcataaatattgttaaattgttaatgtttactaaactaagataggacagctctaagtatagattgttttacatagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaa

SEQ ID NO: 364768 - DNA, 448 bp, Homo sapiens
tatcgaaacctcaattactgttatgaatttactaaatgagttaactctgatttttctcattgtttattgaaatcagttcttaaaaatgctgaatctgatttcattgtatttctagggtgataaaagaaaatgtggctgaagttacccgaagttcagcttgcagtgtaattcagaagagttaagaccagaagtactggaatcatacttcctttcagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364769 - DNA, 737 bp, Homo sapiens
cttttaaattgctgtattatgtaggtatctgaaaatccaaagaacgaatctcatatatgggtaaggaaatatatgggaaaggaaaaaaattgtgtacataagctgtctgtggcatagatcaagcctgtggcattctgtggccttcaaagagagaaggggagagagattctataagcttatcaggtagatttgtcattggaactttaggattttaaaattttggttaaaatatgtgaatactgttacttcagttaaagtaactccttttatagattttgctttctaacaaagtcagtgaaaagtaaccgaggttcactccagaaacatgtaaagaaagtaaaattattaaaaggccaaatatttaattcttgtgacattgaatctgcttttattataaagagttaagaaattgccatttccatgacagtttcctccatcaacaatcttaatattgaagcttgaatttaggtctgctggtcagtgattctagtctagcaaattactttaggactgaaagctcttgtttctttagaaaaatatactatggagattaggatcctgtttactagtgaagactctgtctcttttccaggtcaaaacattttgtgggaaatatcctgttcgtgacccaggtttttcatagtctgctctatgtctcctgcttttccttgttttgctaatcatcctccttgagctccactgttttcattctgggcatccaatccagcctttcatgg

SEQ ID NO: 364770 - DNA, 577 bp, Homo sapiens
cagcactagtatattctcattaacaaacaaacagtcagcttcgtttgggagggtgcttcactttcaaagctacccagtataatgcatacaatgcagtacaagcggaactcactcagaagtagcacctgagcttcaaatagactctcctgatcattctactgagtaagattctccacatttaagaatcaatacaggatttacttgcgaggatagtgtataaaaatggaatagtttttctatttctggactgaaaccaaactcctcatatctaattgtagttattcaacattatcagaatccctatttattttggcagaacagacaaaaggacgtggaatgtactttctgctacagccattacagtcaactagatttgagtgctgccgctggtaagttaattgaatagccaagttatgttgtccttacccaagtagacagtggaaaggaataatggcagaggccatgatgcgagtctggccacagccatgcatcccatctgtggtgatcttagtcctgagatcacctatgtcctaggccacgaactgaatcatgtactagtaccatatcatctgacttc

SEQ ID NO: 364771 - DNA, 2411 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccactccttggtgtggtggtcttgctggttcgtgttgggaagtagtatggcagcaatgcacaaattcagaatagccaagaaatccctccttttcaacgctctgtgcctgggaaccattagaggagttttaaaaaccatccctcatagcccacaattttgggtcaactctcaaaattgggaataagaaaactggcactgttgggagaaaaatcgttcttactgaaacatgaactggctcaggcaagcaaatagcgggagtcggcacaggaaggagtgtgtgctgcggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364772 - DNA, 2337 bp, Homo sapiens
catattacggctaggtacgaggctgggtgtcggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccactccttggtgtggtggtcttgctggttcgtgttgggaagtagtatggcagcaatgcacaaattcagaatagccaagaaatccctccttttcaacgctctgtgcctgggaaccattagaggagttttaaaaaccatccctcatagcccacaattttgggtcaactctcaaaattgggaataagaaaactggcactgttgggagaaaaatcgttcttactgaaacatgaactggctcaggcaagcaaatagcgggagtcggcacaggaaggagtgtgtgctgcggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364773 - DNA, 2130 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaa

SEQ ID NO: 364774 - DNA, 2151 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaattttaaagggaggaatcaaatgagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaa

SEQ ID NO: 364775 - DNA, 2299 bp, Homo sapiens
ggctttggcggaggggtgggacttgcaccggcgtctcttcttctaactgcagtttgtggcagcgccattttgaatgtgcagctgcagcgggcgtgagttgggggagcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccactccttggtgtggtggtcttgctggttcgtgttgggaagtagtatggcagcaatgcacaaattcagaatagccaagaaatccctccttttcaacgctctgtgcctgggaaccattagaggagttttaaaaaccatccctcatagcccacaattttgggtcaactctcaaaattgggaataagaaaactggcactgttgggagaaaaatcgttcttactgaaacatgaactggctcaggcaagcaaatagcgggagtcggcacaggaaggagtgtgtgctgcggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364776 - DNA, 1879 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaaaaaaaaaaaaagaaaaaaat

SEQ ID NO: 364777 - DNA, 1762 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttctttaaaaaaaaaaaagaaaaaaat

SEQ ID NO: 364778 - DNA, 1368 bp, Homo sapiens
agatgctgaggtgggcagatcacttgaggtaagttcgacaccagcctggccaatatagtgaaaccccgtctctactaaaaatacaaaaatcagccaggtgtggtggtgcgcacctgtaatcccagctacttgggagactgaggcaggaatgattaagggaatgttggcagaggctagcagtgtagtgcttcttccaaggacaatgtaaaacattttttttcttttagagatggggtcttgatatgttgcccaggctgggctcaagcagtcctctttcctcatcctcctgagtggctgagacaacaagcacatgccactgtgcccagcagaacagtgtttttccaattgatttcattgtatttctagggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccactccttggtgtggtggtcttgctggttcgtgttgggaagtagtatggcagcaatgcacaaattcagaatagccaagaaatccctccttttcaacgctctgtgcctgggaaccattagaggagttttaaaaaccatccctcatagcccacaattttgggtcaactctcaaaattgggaataagaaaactggcactgttgggagaaaaatcgttcttactgaaacatgaactggctcaggcaagcaaatagcgggagtcggcacaggaaggagtgtgtgctgcggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364779 - DNA, 983 bp, Homo sapiens
  misc_feature (41)..(41): n is a, c, g, or t
acacatcgaactaaacacacataacataaaaggagaagggnctttagctgcaacgactctcttatgtaccaccgctacacggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccactccttggtgtggtggtcttgctggttcgtgttgggaagtagtatggcagcaatgcacaaattcagaatagccaagaaatccctccttttcaacgctctgtgcctgggaaccattagaggagttttaaaaaccatccctcatagcccacaattttgggtcaactctcaaaattgggaataagaaaactggcactgttgggagaaaaatcgttcttactgaaacatgaactggctcaggcaagcaaatagcgggagtcggcacaggaaggagtgtgtgctgcggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364780 - DNA, 1149 bp, Homo sapiens
  misc_feature (10)..(10): n is a, c, g, or t
  misc_feature (19)..(19): n is a, c, g, or t
  misc_feature (60)..(60): n is a, c, g, or t
cccgggtttnccattcccncttttaaaaacccggccaggcccaagttgaagcctcaagtnacttaaaaggacccctcttttgggccgggtaccataatagattttcctttgcttggaatctaggcatgtgtctttcatctgttggaataaaaacattaaaaataatttgtgatatattttatataatctgattcattagtaatctaatcttgcaatataaactgggtgcattaagcatttgtagtatattaagcctgggagactgaagtttcttttcagcattcttattaagtttatgatgatggaaacttttcaaaatttttaatgaaaaatgatgtcccaattcactcttttctttttgattttagatgggaaatgtaaagtcataagatcgataggttgactgtgacaactatgtttacttacagagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaa

SEQ ID NO: 364781 - DNA, 1200 bp, Homo sapiens
tgtaaccttatttttagcataattccctaaagctatttgtgttatatgttcaaatacatttcaacatgaacttggtaacagtcatttctattttaagacttcagtgacctgggaggagaaaataattggctctggtggttatcattactagattttcctttgcttggaatctaggcatgtgtctttcatctgttggaataaaaacattaaaaataatttgtgatatattttatataatctgattcattagtaatctaatcttgcaatataaactgggtgcattaagcatttgtagtatattaagcctgggagactgaagtttcttttcagcattcttattaagtttatgatgatggaaacttttcaaaatttttaatgaaaaatgatgtcccaattcactcttttctttttgattttagatgggaaatgtaaagtcataagatcgataggttgactgtgacaactatgtttacttacagagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaa

SEQ ID NO: 364782 - DNA, 699 bp, Homo sapiens
agatgctgaggtgggcagatcacttgaggtaagttcgacaccagcctggccaatatagtgaaaccccgtctctactaaaaatacaaaaatcagccaggtgtggtggtgcgcacctgtaatcccagctacttgggagactgaggcaggaatgattaagggaatgttggcagaggctagcagtgtagtgcttcttccaaggacaatgtaaaacattttttttcttttagagatggggtcttgatatgttgcccaggctgggctcaagcagtcctctttcctcatcctcctgagtggctgagacaacaagcacatgccactgtgcccagcagaacagtgtttttccaattgatttcattgtatttctagggtgataaaagaaaatgtggctgaagttacccgaagttcagcttgcagtgtaattcagaagagttaagaccagaagtactggaatcatacttcctttcagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364783 - DNA, 425 bp, Homo sapiens
agatgctgaggtgggcagatcacttgaggtaagttcgacaccagcctggccaatatagtgaaaccccgtctctactaaaaatacaaaaatcagccaggtgtggtggtgcgcacctgtaatcccagctacttgggagactgaggcaggaatgattaagggaatgttggcagaggctagcagtgtagtgcttcttccaaggacaatgtaaaacattttttttcttttagagatggggtcttgatatgttgcccaggctgggctcaagcagtcctctttcctcatcctcctgagtggctgagacaacaagcacatgccactgtgcccagcagaacagtgtttttccaatgtacgtaataaacactcaaggagcttttaaaaaatgtgggttcttagatcatactactaataattgatttgttttgtga

SEQ ID NO: 364784 - DNA, 813 bp, Homo sapiens
ggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttctttagcctttgtcattttgtgacccaggtttttcatagtctgctctatgtctcctgcttttccttgttttgctaatcatcctccttgagctccactgttttcattctgggcatccaatccagcctttcatggtgtgtgcttcatcaggcccctggttcacatgctgagtgccttataagcctggccagcactagtatattctcattaacaaacaaacagtcagcttcgtttgggagggtgcttcactttcaaagctacccagtataatgcatacaatgcagtacaagcggaactcactcagaagtagcacctgagcttcaaatagactctcctgatcattctactgagtaagattctccacatttaagaatcaatacaggatttacttgcgaggatagtgtataaaaatggaatagtttttctatttctggactgaaaccaaactcctcatatctaattgt

SEQ ID NO: 364785 - DNA, 1742 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364786 - DNA, 2357 bp, Homo sapiens
  misc_feature (17)..(17): n is a, c, g, or t
  misc_feature (32)..(32): n is a, c, g, or t
gtgcccatggtttaacntccccccccgcgtantgtagcgaggctgggtgtcagacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccactccttggtgtggtggtcttgctggttcgtgttgggaagtagtatggcagcaatgcacaaattcagaatagccaagaaatccctccttttcaacgctctgtgcctgggaaccattagaggagttttaaaaaccatccctcatagcccacaattttgggtcaactctcaaaattgggaataagaaaactggcactgttgggagaaaaatcgttcttactgaaacatgaactggctcaggcaagcaaatagcgggagtcggcacaggaaggagtgtgtgctgcggggatgcgtggtggcgtcaccttcaaaactaaagtggtgccaggcggacagatgagtccttgatcttgtttcctgatcttgtttccatttgactgaattctgaaccttcattgtcttcacagtcttgccacttgcctagtgaggcttttccgaacctggaaggagacgtctagaaatcccaactttgctgtgtaaggaccattagctgcaagtcagtggaagtctatagaaagcagtgtgaattccatagtggtcttgacttcttagcaaggatttgggataagtctaaaacttcagacttaaagctttgaagcatgttaactgcatgaaatattaaacatttcgaacttcttta

SEQ ID NO: 364787 - DNA, 2458 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaaaaacaacacacaaaagaaaaaaaaacaacagcacaacaaacagaaaagagagcgggggcggcgcccccgaaagaagatccaccaccggaggggcaccccaacaacgacgaagccaacgccacagagatactttcgggcgaacaaaaggggaggggccccaacaaaaagaggacagcagaggcaattataaaaaacagacaagaacgcaggaggagccacgcgactatcaacaaaacaacaggaggcgaacaaggcgggagaacaacgcggccacacacacggcgaaaaactcaggcgagagaagagcacacaaaaccacgagagggga

SEQ ID NO: 364788 - DNA, 2186 bp, Homo sapiens
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgttgttacacattctagaatgtgtaacaacgacaacatttttaaaacatatggtacagacatcacaaatatttcccaaatgatctattcccaaaaagcattacagggaagtaagttcttgtataaccatcccagaaagaccgtaccataattggaggtttctctttccaataagacactttaaatgtagtactgttttgttacatgacaatttcaaatcaagtcatctcaaaatcgtatctgacagccttggaactacccccgccttattacactattaataaatagaattacatgaaattaagctttaattctatcaaatctcctgacacacagtttcttgtccgccctgggtctaattaccttctctccgcg

SEQ ID NO: 364789 - DNA, 1672 bp, Homo sapiens
  misc_feature (1576)..(1576): n is a, c, g, or t
  misc_feature (1588)..(1588): n is a, c, g, or t
  misc_feature (1636)..(1636): n is a, c, g, or t
ggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatcctgaatatataaagaactcctacaggtcaacaacaacaacaacacanatcccacttcanaaatggctgaaggacttaaatagacatttatctgaagaagatacacanatgaccaaaaagtacatgaaaagatcctcaacatta

SEQ ID NO: 364790 - DNA, 412 bp, Homo sapiens
cggcacgaggattctgatgttttatttatagggtgcactcttcattgtttaaatgtctatttttagatgttgatagacctttgtaggtagtttcacccctgtctttggttctcttgcactgtttgccccatatcattctaaatttttacccaaatgggttttcaaggaccttgctcctcctgcctgtgggaagtggttacaggttagcaatagttgaaactcccctactgtttttcccagcttagcagggtggttggagaccagcccccctctttcccctttaaataccaaagtcctcaaaatcctctctggaaaaaagcacaggccacagaccctattgcagcttgagtctctttttcctggctgtgtcctccaccatggcaaaataaatctctaaatcgattgaaacctg

SEQ ID NO: 364791 - DNA, 453 bp, Homo sapiens
tgcgggcaggtggggtgtggcctggttgggcagtatagagctaccagctaccaatggtgttcagccctcagggtcgagcgtgggttgtctcagccccttgcaggcagggctggagttccttctggtgcgagttgggggacccagctcccccatccctctgcaaccccaggccccccaccaggtcccctctggttcagcctggtgccttccagcacccctggcccccagaaatccctggtccacagctcccttgacctgaggcctgaaattgacccactgccccctgaggcttggtccaagtccaagtatgccttcctctccagccagatgcctgcctgccactcagcatgtcagagcaggcagggcctctagattttaatggggaaactgaggcactgagggcagatgtgatgtccccagttgggaaaacattaaagacattctgggcttctc

SEQ ID NO: 364792 - DNA, 331 bp, Homo sapiens
atcagcctcctgagagctgggactacaggcgcctgccaccacatccggttaatttttgtatttttagtagagatggggttttgccatgttggccaggctggtcttgaactcctgagctcaggtgatccacctgccttggccttccaaagtgctgggattacaagcgtgagccactgtgcccagcccccctctttcccctttaaataccaaagtcctcaaaatcctctctggaaaaaagcacaggccacagaccctattgcagcttgagtctctttttcctggctgtgtcctccaccatggcaaaataaatctctaaatcgattgaaacctg

SEQ ID NO: 364793 - DNA, 3306 bp, Homo sapiens
  misc_feature (461)..(461): n is a, c, g, or t
  misc_feature (2879)..(2879): n is a, c, g, or t
  misc_feature (2884)..(2884): n is a, c, g, or t
  misc_feature (2954)..(2954): n is a, c, g, or t
  misc_feature (3058)..(3058): n is a, c, g, or t
  misc_feature (3060)..(3060): n is a, c, g, or t
  misc_feature (3109)..(3109): n is a, c, g, or t
  misc_feature (3113)..(3113): n is a, c, g, or t
  misc_feature (3119)..(3120): n is a, c, g, or t
  misc_feature (3124)..(3124): n is a, c, g, or t
  misc_feature (3128)..(3128): n is a, c, g, or t
  misc_feature (3132)..(3132): n is a, c, g, or t
  misc_feature (3146)..(3147): n is a, c, g, or t
  misc_feature (3157)..(3157): n is a, c, g, or t
  misc_feature (3169)..(3169): n is a, c, g, or t
  misc_feature (3185)..(3185): n is a, c, g, or t
  misc_feature (3193)..(3193): n is a, c, g, or t
  misc_feature (3198)..(3198): n is a, c, g, or t
  misc_feature (3203)..(3203): n is a, c, g, or t
  misc_feature (3212)..(3213): n is a, c, g, or t
  misc_feature (3224)..(3224): n is a, c, g, or t
  misc_feature (3226)..(3226): n is a, c, g, or t
  misc_feature (3244)..(3244): n is a, c, g, or t
  misc_feature (3247)..(3247): n is a, c, g, or t
  misc_feature (3250)..(3250): n is a, c, g, or t
  misc_feature (3253)..(3253): n is a, c, g, or t
  misc_feature (3262)..(3262): n is a, c, g, or t
  misc_feature (3265)..(3265): n is a, c, g, or t
  misc_feature (3277)..(3278): n is a, c, g, or t
  misc_feature (3284)..(3285): n is a, c, g, or t
  misc_feature (3293)..(3293): n is a, c, g, or t
  misc_feature (3302)..(3302): n is a, c, g, or t
atcagcctcctgagagctgggactacaggcgcctgccaccacatccggttaatttttgtatttttagtagagatggggttttgccatgttggccaggctggtcttgaactcctgagctcaggtgatctgcccacctcggcctcccaaagttctgggattacaggcgtgagccacggtgcccagcctggctcctgttttttgagacggggtttcaccctgtttcccaggttggagtatagtggtgccgtcatgacttactgcagccttgaactctttggctcaagcagtcctccccactcagcctctctagtagctggggctccaggcatgaatcaccgtgccagactaagtttttttaaaattttttgtagagagaatctctctctgttgcacaggctattcttgaactcctaggctcaagtgatcctcctgcttcagcctccgaaagtgctgggattacngttgtgagtcactgtgcctggctcttttaatcttgaaaactctgggaagagctcacttctgtttaggaggctgccttgggaactgcatctcctgggctggtgctctgtgctgcttggagtctgcagaccctatctgggtcgcttggcctcccgtgcacaagctgccagaatggaggccccattctcaatgtgggggctgcccaaagagcagggagcttcccacaggacagaggctgggcacctgcttggcctggttcttccttttcccagggctccaacacccaccccctcaggtcctcccaaaccctgcaggtccctggcctggtccgtccacacctacactcaggaatctctacacatctctgagttgctgcatctgtcttcaggcacagcccaccagcccccctgggtacccaaagacaccgcaaatatcagccattccagacaacgtcctcccgtgtccctatctcatggagtaatgcctctaattcagccacaccaagaccccacgctccacatcccctagaactctcatctcctgtggcccaacatggcccttcctttcagcagtgggatgtgggaaggatcaaggtcacccttgtccaaatcccatgcagacaacggtgttggagtcttgggcccaaagaccagctcctagaacctgcagggaagcaacggcacgttccatctctccccatgccactgaggaatcattggtggcaggattctcagcaggcatggccgtgggtgcacagaacagagaaaggatggcctggaccacacacatcactgtgtgcagatgctttcctagacactgcagccaaggacacagaggctcagagagaataacctccatctcctgggtcccagcgattctcctgcctcagcctcttcctatttcacaagtagggaaactgaagcccaggctgtttgctcagttgcaaaatgggaaggacaacagcacccgcctcacaggctaagaggctgtgtgtgaaaagcccgcagcacaggatctggcacgcgtggacgtgcgggatgggaggaggggatttcccagctcctcatctctgcagggactggccttggcctagggaacactagctgtccagggagggggagctttccctgagccccccgatgtgtggcaggcagaggagagcaagctacttctgggaggggagttgtggggaagggcaagttagtctttactgagggtggcagtgagctggcactttggtctcacctcggctgcagaaacccaccctgctcccgtcttatttcctggggatttcagctgtgtgcaggcacagatgcatctccgaagtgcctcatgcttgccttgatctcctctccttcctctggccagtcctgaacctcttggtgatccacggcggcacctctgtgtcctacatccttctctggccatctccttccctccttccagccctccctctaggaccctgaccccaaccatccttcatccccatggggacattcagtccactgactcatcaccctcccctgtccctctgtgagagaaggagcaggcagagaggatcttgcaagagccttcagcaactctcttccacccatcctgttgcttgctgctttttttttttttttttccaaaaaaatagagatggggtcttgctatgtggctggtctcaaactcctgggctcaagtgatcctcctgcctcggcctcccaaagtgctggattacaggcgtgagccaccacacccggctccgttccctttctaagcagggtgctccttttcttgccatttcccccatcctccttcctctcccacagctcacttccctctctactgaatctgctgaagatcatgcagctgctgttcctgcctctaaaaccctctcttggctgggtgtggtgggtgacatatgtaatcccagcactttgggaggctgaggcaggagaatcacttgaacccgggaggcggaggttgcagtgagccgagattgcgccactgcactccagcctaggtgatagagcaagactctgtcccctccctccaccaaaaaaataaagccctctctgcatccattccactctccactcttgctcattctctcctgccctctaaaaggtgatctgtctttggcagattcaatcacttgcctttctcattctctcctgagcccactattccactctggtccccaccacttcccccaaaactgctttgaaccatcgcactgcaacctgttgcttagcccctccatctagtctcaggcgttaggactgactgcccagcagaggctggtgcaaccaatcacctcctttagtaagtttctccctgggcttcacctcttcacctgtgggctttccacctgtctctctcttttttttttaagacagtctcctctgttgccaggctggaatgccgtggcgcantctcngctcactgcaacctctacctcctgggttcaagcgattctcctgcctcaggctcccaagtagctgggattncaggtgcccgccaccacaccgggctaatttttgtatttttagtagagtcggggtttcaccatgttgcccaggctggtctcgaactcctgaccttacgtgatccncncgcctgtaatcccagcactttgggaggttgaggcgggctgatcacctgnccancatggnnaaancccntctntactaaaaatacannaattagccgngtgtggtggcgngcacctgtaatcccanctactcangaggntgagncaggagaanngcttgaacccngnaggcagaggttgcagtgngcnganatngcgccattncantccagcctgggnnacgagnnaaactccntctccaaanaaac

SEQ ID NO: 364794 - DNA, 1541 bp, Homo sapiens
  misc_feature (461)..(461): n is a, c, g, or t
atcagcctcctgagagctgggactacaggcgcctgccaccacatccggttaatttttgtatttttagtagagatggggttttgccatgttggccaggctggtcttgaactcctgagctcaggtgatctgcccacctcggcctcccaaagttctgggattacaggcgtgagccacggtgcccagcctggctcctgttttttgagacggggtttcaccctgtttcccaggttggagtatagtggtgccgtcatgacttactgcagccttgaactctttggctcaagcagtcctccccactcagcctctctagtagctggggctccaggcatgaatcaccgtgccagactaagtttttttaaaattttttgtagagagaatctctctctgttgcacaggctattcttgaactcctaggctcaagtgatcctcctgcttcagcctccgaaagtgctgggattacngttgtgagtcactgtgcctggctcttttaatcttgaaaactctgggaagagctcacttctgtttaggaggctgccttgggaactgcatctcctgggctggtgctctgtgctgcttggagtctgcagaccctatctgggtcgcttggcctcccgtgcacaagctgccagaatggaggccccattctcaatgtgggggctgcccaaagagcagggagcttcccacaggacagaggctgggcacctgcttggcctggttcttccttttcccagggctccaacacccaccccctcaggtcctcccaaaccctgcaggtccctggcctggtccgtccacacctacactcaggaatctctacacatctctgagttgctgcatctgtcttcaggcacagcccaccagcccccctgggtacccaaagacaccgcaaatatcagccattccagacaacgtcctcccgtgtccctatctcatggagtaatgcctctaattcagccacaccaagaccccacgctccacatcccctagaactctcatctcctgtggcccaacatggcccttcctttcagcagtgggatgtgggaaggatcaaggtcacccttgtccaaatcccatgcagacaacggtgttggagtcttgggcccaaagaccagctcctagaacctgcagggaagcaacggcacgttccatctctccccatgccactgaggaatcattggtggcaggattctcagcaggcatggccgtgggtgcacagaacagagaaaggatggcctggaccacacacatcactgtgtgcagatgctttcctagacactgcagccaaggacacagaggctcagagaggtaaagaaacttacccaaggtcacacagccactaagcaccaagagtactctgtgtcgaccccaaagccctggtctttccactctaccatgagccctgggtttcctggtgtctcagattcccctacagtttttctttcttttctttccttccttctttctttctttctttctttctttctttctttctttctttctttctttctttctttctttcatctttctttctttttcttttc

SEQ ID NO: 364795 - DNA, 357 bp, Homo sapiens
ctccgcctactgagttcgagtgattcttgtgcctcagcctccagagtagccaggattacaggcacccgccaccacgcgtgttgaattttttgtatttttagtagagatggggtttcattatgctgcccattatgctcctgacctcaggtgatccacctgccttggccttccaaagtgctgggattacaagcgtgagccactgtgcccagcccccctctttcccctttaaataccaaagtcctcaaaatcctctctggaaaaaagcacaggccacagaccctattgcagcttgagtctctttttcctggctgtgtcctccaccatggcaaaataaatctctaaatcgattgaaacctg

SEQ ID NO: 364796 - DNA, 839 bp, Homo sapiens
  misc_feature (412)..(412): n is a, c, g, or t
  misc_feature (417)..(417): n is a, c, g, or t
  misc_feature (487)..(487): n is a, c, g, or t
  misc_feature (591)..(591): n is a, c, g, or t
  misc_feature (593)..(593): n is a, c, g, or t
  misc_feature (642)..(642): n is a, c, g, or t
  misc_feature (646)..(646): n is a, c, g, or t
  misc_feature (652)..(653): n is a, c, g, or t
  misc_feature (657)..(657): n is a, c, g, or t
  misc_feature (661)..(661): n is a, c, g, or t
  misc_feature (665)..(665): n is a, c, g, or t
  misc_feature (679)..(680): n is a, c, g, or t
  misc_feature (690)..(690): n is a, c, g, or t
  misc_feature (702)..(702): n is a, c, g, or t
  misc_feature (718)..(718): n is a, c, g, or t
  misc_feature (726)..(726): n is a, c, g, or t
  misc_feature (731)..(731): n is a, c, g, or t
  misc_feature (736)..(736): n is a, c, g, or t
  misc_feature (745)..(746): n is a, c, g, or t
  misc_feature (757)..(757): n is a, c, g, or t
  misc_feature (759)..(759): n is a, c, g, or t
  misc_feature (777)..(777): n is a, c, g, or t
  misc_feature (780)..(780): n is a, c, g, or t
  misc_feature (783)..(783): n is a, c, g, or t
  misc_feature (786)..(786): n is a, c, g, or t
  misc_feature (795)..(795): n is a, c, g, or t
  misc_feature (798)..(798): n is a, c, g, or t
  misc_feature (810)..(811): n is a, c, g, or t
  misc_feature (817)..(818): n is a, c, g, or t
  misc_feature (826)..(826): n is a, c, g, or t
  misc_feature (835)..(835): n is a, c, g, or t
tccttgtaatccaagcagtcgtccttaatccagcagtcgaccctccaacctcttcatcctcacccactctccactcttgctcattctctcctgccctctaaaaggtgatctgtctttggcagattcaatcacttgcctttctcattctctcctgagcccactattccactctggtccccaccacttcccccaaaactgctttgaaccatcgcactgcaacctgttgcttagcccctccatctagtctcaggcgttaggactgactgcccagcagaggctggtgcaaccaatcacctcctttagtaagtttctccctgggcttcacctcttcacctgtgggctttccacctgtctctctcttttttttttaagacagtctcctctgttgccaggctggaatgccgtggcgcantctcngctcactgcaacctctacctcctgggttcaagcgattctcctgcctcaggctcccaagtagctgggattncaggtgcccgccaccacaccgggctaatttttgtatttttagtagagtcggggtttcaccatgttgcccaggctggtctcgaactcctgaccttacgtgatccncncgcctgtaatcccagcactttgggaggttgaggcgggctgatcacctgnccancatggnnaaancccntctntactaaaaatacannaattagccgngtgtggtggcgngcacctgtaatcccanctactcangaggntgagncaggagaanngcttgaacccngnaggcagaggttgcagtgngcnganatngcgccattncantccagcctgggnnacgagnnaaactccntctccaaanaaac

SEQ ID NO: 364797 - DNA, 619 bp, Homo sapiens
ttaatggggaaactgaggcactgagggcagatgtgatgtccccagttgggaaaacattaaagacattctgggcttctctctcttttttttagagacaagatctcactctgtcatgcacgctggaatcatggctcattgcagcctccaactcctaggctcaagggatccttccacctcagcctcccgagtagctgggagtacaggtgttcgtccccaccatgtctggctaatttaaaaaaatgtctttgcaggatgggatcttgctatgtttcccaggctggtctcaaactcctgggctcaagtgattttcccatcttggcctcccaaaatactgggattatacgtataagccaccacgtctggcctgagtcatctcttttgacccagaacaaaaccagtccaggagtggctgtactccccaggagtgtacactggggaggcccacagctccggggtgcagtggggctcttgcaatttaatgactgattcatcttcaaaaaagcacaatctcagccaggcgtggtggctcatgcctgtaatcccagcactttgggaggttgaggcgggctgatcacctgaggtcagaagtttgagatcagcctggccaacagggtgaaac

SEQ ID NO: 364798 - DNA, 4960 bp, Homo sapiens
  misc_feature (461)..(461): n is a, c, g, or t
  misc_feature (2100)..(2100): n is a, c, g, or t
  misc_feature (2167)..(2167): n is a, c, g, or t
  misc_feature (3039)..(3039): n is a, c, g, or t
  misc_feature (4533)..(4533): n is a, c, g, or t
  misc_feature (4538)..(4538): n is a, c, g, or t
  misc_feature (4608)..(4608): n is a, c, g, or t
  misc_feature (4712)..(4712): n is a, c, g, or t
  misc_feature (4714)..(4714): n is a, c, g, or t
  misc_feature (4763)..(4763): n is a, c, g, or t
  misc_feature (4767)..(4767): n is a, c, g, or t
  misc_feature (4773)..(4774): n is a, c, g, or t
  misc_feature (4778)..(4778): n is a, c, g, or t
  misc_feature (4782)..(4782): n is a, c, g, or t
  misc_feature (4786)..(4786): n is a, c, g, or t
  misc_feature (4800)..(4801): n is a, c, g, or t
  misc_feature (4811)..(4811): n is a, c, g, or t
  misc_feature (4823)..(4823): n is a, c, g, or t
  misc_feature (4839)..(4839): n is a, c, g, or t
  misc_feature (4847)..(4847): n is a, c, g, or t
  misc_feature (4852)..(4852): n is a, c, g, or t
  misc_feature (4857)..(4857): n is a, c, g, or t
  misc_feature (4866)..(4867): n is a, c, g, or t
  misc_feature (4878)..(4878): n is a, c, g, or t
  misc_feature (4880)..(4880): n is a, c, g, or t
  misc_feature (4898)..(4898): n is a, c, g, or t
  misc_feature (4901)..(4901): n is a, c, g, or t
  misc_feature (4904)..(4904): n is a, c, g, or t
  misc_feature (4907)..(4907): n is a, c, g, or t
  misc_feature (4916)..(4916): n is a, c, g, or t
  misc_feature (4919)..(4919): n is a, c, g, or t
  misc_feature (4931)..(4932): n is a, c, g, or t
  misc_feature (4938)..(4939): n is a, c, g, or t
  misc_feature (4947)..(4947): n is a, c, g, or t
  misc_feature (4956)..(4956): n is a, c, g, or t
atcagcctcctgagagctgggactacaggcgcctgccaccacatccggttaatttttgtatttttagtagagatggggttttgccatgttggccaggctggtcttgaactcctgagctcaggtgatctgcccacctcggcctcccaaagttctgggattacaggcgtgagccacggtgcccagcctggctcctgttttttgagacggggtttcaccctgtttcccaggttggagtatagtggtgccgtcatgacttactgcagccttgaactctttggctcaagcagtcctccccactcagcctctctagtagctggggctccaggcatgaatcaccgtgccagactaagtttttttaaaattttttgtagagagaatctctctctgttgcacaggctattcttgaactcctaggctcaagtgatcctcctgcttcagcctccgaaagtgctgggattacngttgtgagtcactgtgcctggctcttttaatcttgaaaactctgggaagagctcacttctgtttaggaggctgccttgggaactgcatctcctgggctggtgctctgtgctgcttggagtctgcagaccctatctgggtcgcttggcctcccgtgcacaagctgccagaatggaggccccattctcaatgtgggggctgcccaaagagcagggagcttcccacaggacagaggctgggcacctgcttggcctggttcttccttttcccagggctccaacacccaccccctcaggtcctcccaaaccctgcaggtccctggcctggtccgtccacacctacactcaggaatctctacacatctctgagttgctgcatctgtcttcaggcacagcccaccagcccccctgggtacccaaagacaccgcaaatatcagccattccagacaacgtcctcccgtgtccctatctcatggagtaatgcctctaattcagccacaccaagaccccacgctccacatcccctagaactctcatctcctgtggcccaacatggcccttcctttcagcagtgggatgtgggaaggatcaaggtcacccttgtccaaatcccatgcagacaacggtgttggagtcttgggcccaaagaccagctcctagaacctgcagggaagcaacggcacgttccatctctccccatgccactgaggaatcattggtggcaggattctcagcaggcatggccgtgggtgcacagaacagagaaaggatggcctggaccacacacatcactgtgtgcagatgctttcctagacactgcagccaaggacacagaggctcagagagaataacctccatctcctgggtcccagcgattctcctgcctcagcctcttcctatttcacaagtagggaaactgaagcccaggtaggcaagcctgacttgctggagtcacacaggaagttggcagctctgctccatccctgggatctggagcccctgctctggggaaggagaggtggggcgctgccttcccagagtcccctcaagctggcagggacggctgtacccccagggtcagaggagaactaaaaggagcggaagctggcctgggtccagggagagacctcgtgtttgcccaaaagggagctggagaggggcagctgggcccatatgcagggaggagctgcagggagctggtggcggggcagcaaagagaagtggatttggtgggtagaggggcccctccttggttctagtcctccccgcagccccttgcaaacaggcggggctctcctgtccttcttctctcctgcagcaagccctacatgaagaggcctctttggtgagtggcagctcaacctctgctaaatgcctccagtgatggggagttcactaccttccaaagtttttaaaagatgttaaccactgctattcaagaacaattctagaattttttttttttttgaaagacaaggtctcattctgtctcgcaggccagagtgcagtggtgtgatcatagctcactgcagctttgacttcctgggctcaagcaatcctccctcctcagcctcctgagtacctgagactacagatgtgcaccaccacactggctcattgttttcattttttgtagagacnggatctcactatgttgcccaggctggtctcctggcttcaagcaatcctcctgccttggcctcccaangtgctgggattacaggcgtgagccactgcatctggccttttttttttggagatagagtctcgctctgtcgcccagggtggagtgcagtggcgtgatctcggctcattgcaacctccgccttccgggttcacaccattctcctgcctcagcctcccgagtagctgggattacaggcatctgccaaccatgcctggctaatttttgtattttttggtggagacagggtctcaccatgttggctaggctggtttcgaactcccgacctcaggtgatctacccgcctcagcctcccaaagtcctgggattacaggctgagccaccgcgaccggccctgctgttgcttctgaggtttgaaaaccgctgcctcaatgctcctgattcagctcttcttacccaaaggttcccccacctcatctactctgttcctgcacagtcgcccttttctctgatgccccgggcaggtttctctctgccagctccacgcttctggagtcccccatccgtcttggggcccagctgcccactgtctgggttcagaccttctcaacactccctggcttctctgccctagttttgccttctccaatccactcttggtgggtggaagtacggttaccatggtaacttgaagacaacgcaaatctgattgtatcattacaatgactgggaaaacctccagtgccacaaaataaagctcaagtcactagctttgcagtccaggccctttaccattccggcagcatttctgggggctattctccttccccccactgcacaaccccgcctggccaccccaggctcaggctgcagaacagcgtagaccagggagtggctttggggtcatgctaactacctggtttttgtctctttcnggctgtttgctcagttgcaaaatgggaaggacaacagcacccgcctcacaggctaagaggctgtgtgtgaaaagcccgcagcacaggatctggcacgcgtggacgtgcgggatgggaggaggggatttcccagctcctcatctctgcagggactggccttggcctagggaacactagctgtccagggagggggagctttccctgagccccccgatgtgtggcaggcagaggagagcaagctacttctgggaggggagttgtggggaagggcaagttagtctttactgagggtggcagtgagctggcactttggtctcacctcggctgcagaaacccaccctgctcccgtcttatttcctggggatttcagctgtgtgcaggcacagatgcatctccgaagtgcctcatgcttgccttgatctcctctccttcctctggccagtcctgaacctcttggtgatccacggcggcacctctgtgtcctacatccttctctggccatctccttccctccttccagccctccctctaggaccctgaccccaaccatccttcatccccatggggacattcagtccactgactcatcaccctcccctgtccctctgtgagagaaggagcaggcagagaggatcttgcaagagccttcagcaactctcttccacccatcctgttgcttgctgctttttttttttttttttccaaaaaaatagagatggggtcttgctatgtggctggtctcaaactcctgggctcaagtgatcctcctgcctcggcctcccaaagtgctggattacaggcgtgagccaccacacccggctccgttccctttctaagcagggtgctccttttcttgccatttcccccatcctccttcctctcccacagctcacttccctctctactgaatctgctgaagatcatgcagctgctgttcctgcctctaaaaccctctcttggctgggtgtggtgggtgacatatgtaatcccagcactttgggaggctgaggcaggagaatcacttgaacccgggaggcggaggttgcagtgagccgagattgcgccactgcactccagcctaggtgatagagcaagactctgtcccctccctccaccaaaaaaataaagccctctctgcatccattccactctccactcttgctcattctctcctgccctctaaaaggtgatctgtctttggcagattcaatcacttgcctttctcattctctcctgagcccactattccactctggtccccaccacttcccccaaaactgctttgaaccatcgcactgcaacctgttgcttagcccctccatctagtctcaggcgttaggactgactgcccagcagaggctggtgcaaccaatcacctcctttagtaagtttctccctgggcttcacctcttcacctgtgggctttccacctgtctctctcttttttttttaagacagtctcctctgttgccaggctggaatgccgtggcgcantctcngctcactgcaacctctacctcctgggttcaagcgattctcctgcctcaggctcccaagtagctgggattncaggtgcccgccaccacaccgggctaatttttgtatttttagtagagtcggggtttcaccatgttgcccaggctggtctcgaactcctgaccttacgtgatccncncgcctgtaatcccagcactttgggaggttgaggcgggctgatcacctgnccancatggnnaaancccntctntactaaaaatacannaattagccgngtgtggtggcgngcacctgtaatcccanctactcangaggntgagncaggagaanngcttgaacccngnaggcagaggttgcagtgngcnganatngcgccattncantccagcctgggnnacgagnnaaactccntctccaaanaaac

SEQ ID NO: 364799 - DNA, 390 bp, Homo sapiens
atatatagataacatgtaactggaaaacatggtttgtgatgtgtctccttttgtagttttatgtaatgagaaaaggcaggcaaggtaaagtcaattttggaagaagctttcatttcaggtatctgaacacttaagagtatttttattttagatcacctttcccattcttggggcatatcaccccaagggcatcataatgctttcttgatctgtggcatgattgccacttgtgtaggcatttactgtaaatgcataagaaacttccatttagattaggtattcacaaggaatgtttaacagtgagtgtgcccagggattgggattagactgttcagggaacttctttatcctttgagattttattatttaagaaaattaatggcaaaaaaa

SEQ ID NO: 364800 - DNA, 526 bp, Homo sapiens
tcgtcctctctgcatctagctcttcttcctctggctggccaccccaggttctttgctgtggactcataaaaagtgagctttccttagacctctctgtgcatcccccactttgtaggttcactttggtgtatatgagcctggcttctgagttccttgcatacaaactctgactggtccttctgctccagggcttcagaaggagtgattggtgtccccaccaggatcagtaccaccgccttcacttccccagcccctcacacactggcaaagtctaattgctgtaagcattcctcctgtcacgtcactggtaatggttctgcatccctgactggtacagcatccagcctcagttagaaaaaataaccacctaaaaacccctcagaaaatggaaggatataatgaaacaagaactggaattaagtggaaaaaacttttttacattagacaggatcaagaaagccaaaagtttgttctttgaaaagatgaatagagttgacaaacctctgccaagattgatcaaggaaaa

SEQ ID NO: 364801 - DNA, 365 bp, Homo sapiens
ctctgccattgtggtgaatactgacagggagtcaggcagtccagcacctactaggactctgccacagctgctactatgagactagatccactgtcactgcactatgaaacacttggctgacaccacccattggagtgcagtgaccagcagtctgggagcacctccttggccccttccccagtgaagtggattcctatcattaagaaaccagagaacaaagttgggacccagtacaaatcttccagaattaaaacatatagtctaggagttgggggctgtgcattggccccctaaaatcttccagaaataagtccagctggctgaatcaaccttatacgagaatcaaaccctcaaattcatctaat

SEQ ID NO: 364802 - DNA, 1410 bp, Homo sapiens
tgatgatgattgtcttaacatgtatttctaatcactttaaaacctcactgtgatagatttgcttgttctttgtacttttgtggtacaatctaatagatttttttctttgaggtttactctatttttagatattaaaagtattttaaactgaaatgatgactcatacgtggatataagaaaataaaaagcagctctgtttcctacattttttactgctttttactctcccaatttttatgtcttttcatcaattctgcaatagacagagattaatagtagcacttgcagttttcgctgagacatatccagttcactgaagacccactttagtgttttgggaggaaaaaacaagtcttttctgaaataatgagttcaagattgatttgaggtttaggaagacttttagcaaactcaatcgctcaggagctgattctcagcttatcagtaatcacatcctttcctattcccttctgcagacaatatctgactattttcaggcttgttagaagggagagtaagaggaagtttagttctagatcatctatttttttttccctgtaagtaagttgctttgatataagatttggtggtggtaatcagttgcttaaatgatatcctaaaataatctccagctcatttaataactgccttcactaaatttttattaatggttttgttttagttttaagctcttttaagtctttttcaggccttctttaactccgtcctgacaagtgtggttttgaatactgatttctgtctttgacttgacttttagtatatttaagtggtgtgagttttggataagtttccttttaaaatgatcccacaaaatatagagagaacaattctcctgcctcagcctcctaaggagctattttttgtattttagtagagacagggtttcaccgtgttggtcaggctggtctcgaactcctgacctcaagtgatccacccgccttggcctcccaaagtgctgggattacaggtgtgagccaccgtgcccagctagattctttactttttaataaagttcaaaatagcttttaataaggttgtcaaatttgaccaaaatttcatagaagtccaaaatattatgcctctttctgtagatcaaatgaaatatggcccaatttacaagggtatacaccttcatggtagatgaatatagattttaaactagttttaaaaggaatatgaatgatttaattgtagtttctgctgccaaaaagtctccataattattttttaataacttataactaccttgatctttacctgtacacacacacacacacacacacatgcacagagtaatttcacttagaatcctggtcaaaaattttcttccacttaaattttttttaagactctcacaaatatacatcatggttttctttagtcggcaaa

SEQ ID NO: 364803 - DNA, 810 bp, Homo sapiens
aaaagatttcaagctttcatacatttattccttcattaaattctttctcagtaccagttatgtgttaggtacaaattatgctgatattaatctcttgaatataaatatatgtgccaaaatatgctaatataaattctttacttgttgttgttgttgttgttgagacggagtcttgccctattgcccaggctggagtgcagtggcgcgatttcagctcactgcaacctctgcctcccaggttcaagcaattctcctgcctcagcctcctaaggagctattttttgtattttagtagagacagggtttcaccgtgttggtcaggctggtctcgaactcctgacctcaagtgatccacccgccttggcctcccaaagtgctgggattacaggtgtgagccaccgtgcccagctagattctttactttttaataaagttcaaaatagcttttaataaggttgtcaaatttgaccaaaatttcatagaagtccaaaatattatgcctctttctgtagatcaaatgaaatatggcccaatttacaagggtatacaccttcatggtagatgaatatagattttaaactagttttaaaaggaatatgaatgatttaattgtagtttctgctgccaaaaagtctccataattattttttaataacttataactaccttgatctttacctgtacacacacacacacacacacacatgcacagagtaatttcacttagaatcctggtcaaaaattttcttccacttaaattttttttaagactctcacaaatatacatcatggttttctttagtcggcaaa

SEQ ID NO: 364804 - DNA, 417 bp, Homo sapiens
aacagatgattggagagattgaagagtgaagtccctgctttaaagtgtactcctgtggacacagtaatacatatacttaaaatggttcatgttaagagtaggtatatttctatctaaatactctgtagcttttgtgattcaggaaaacgagtggagcctcacaggcacaagaatctagtaaattctaggtttcttgtgtggaaatcagtgtgcaaaatcttaacggagtgaattcttgattgttgatatcacatttgttagtctgtatgtatctgtgtcattgatctccttaagaagagactcgtagatattgactgggagacctaagctgaatgctaaaatctgctccatggatataagctgatgcagtcatcatttctcattaaaatgcatcacagctagatatgcagcaaaaaa

SEQ ID NO: 364805 - DNA, 139 bp, Homo sapiens
gttgccagtagtgccaaagacacgcatggaggtgtcaggggctccaccagccttttcttctctacatccttgcccctccccttccctcctttctttctgtttcccttttctttcccttacatcctcccctctccttgac

SEQ ID NO: 364806 - DNA, 3850 bp, Homo sapiens
  misc_feature (3846)..(3849): n is a, c, g, or t
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtacttggaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcattctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaaannnna

SEQ ID NO: 364807 - DNA, 450 bp, Homo sapiens
aattaatttgaagtattaaatttagacaaaatggcatactcttaaatcacctccaaaaaatgggcagtgtttaggctgactgcaaatgaagcagagaagacactggggttataataaatagaaaatcatactacaagaatgtatacaattacatattacaaagtacaatattctgttaaatagtatgttgacatttgctaaaggattaattttcaggaaactaagggtgttcctcaaattacataaaaccattcagattatttatttgaacatttctagaactgtcaccacatctggacaatttatataattatgaagtacttttaaatggctaaattcctttatagctattttatcacccattaactggactataaaaaccctgaagaaatcagcatagaactgatccaactggccccagaaaaagtgtaaagggctatgctcatactg

SEQ ID NO: 364808 - DNA, 325 bp, Homo sapiens
aattatctgttcatcatatttgtccattgttttattggatgttcatgttttcttaataatatataagagctctttatctattactacctacagactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggtaaggcaagccttgctgatgtggaggctgaaatccctctagcattgcttttcattgtatctatataggattt

SEQ ID NO: 364809 - DNA, 185 bp, Homo sapiens
gaaacaaaacacattttattggcatattaatttttactttggcaccccattctgcctaatttgctttgtaaacaaacacgttcttctagttgcttcagattgactattacaacctgaccaagttctacggcacagtgaaacttgataccatgatcttcggggtgatagaatactgtgagagagga

SEQ ID NO: 364810 - DNA, 536 bp, Homo sapiens
tggtctcaaactcctgaactcaggtgctccgccctcctcagcctcccaaaatgctgggtttacagacatgatccacctcacccggcctccaaggaagagttttctaaaagtctcctttaataacatcccttcaattcccctgatatccctttaactttccagtaaccctgctgatcccaacaaccttttgttctaggctcaagacaagattcttttttgaaggacccgttttaatattttccttttttatttagacaaaacgagactttgctcttgcctatttgaatggaatcctgctctttggacatatgctgaagatatttcttgaaaatggagaaaatattaccacccccaaatttgctcatgctttcaggaatctcacttttgaaggtactggtctactaagagcaaataaccccaaggtgaagaaatgtaggctttctgagtggatttggggcaacaaagaaggtttagcaatagatgattccacagctaaatccctttgaactcaactggatgcaaacatcattacataa

SEQ ID NO: 364811 - DNA, 566 bp, Homo sapiens
ttacataaaaccattcagattatttatttgaacatttctagaactgtcaccacatctggacaatttatataattatgaagtacttttaaatggctaaattcctttatagctattttatcacccattaactggactataaaaaccctgaagaaatcagcatagaactgatccaactggccccagaaaaagtgtaaagggctatgctcatactgtgttcccaaatcactttttgtgtttgacatgtgattaactgcttctgtttactttctatacttttcaaaggggcagaggcactcatgagaaactgtttccacaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtatggagttgagcatcttagcaaattgggaaccatatgtactgctgtgcaccaactaaatcagaaaggataaaa

SEQ ID NO: 364812 - DNA, 3810 bp, Homo sapiens
  misc_feature (3806)..(3809): n is a, c, g, or t
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtacttggaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcattctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaaannnna

SEQ ID NO: 364813 - DNA, 5102 bp, Homo sapiens
agcggagtgggggggaggcggcggcagcggcagcggctgcgggcagcgcgcggggcgcagggcgcggggcgatcaccgtcggggctcgggaggcgggcagtgggcacaggctccccggtgcccgcccctccgctgcggaggggggccgcgagcgggcggccggggaggggccggcaccgccgccacaaaatgagcctgctgtcggccatcgacacgagcgccgcctcggtgtaccagcccgcccagctgctcaactgggtctacctgtcgctgcaggacacgcaccaggctagcgccttcgatgccttccggcccgagccgaccgccggcgccgcacccccggagctggccttcggcaagggccgccccgagcagctgggctcgcccctgcactccagctatctcaacagcttcttccagctgcagcgcggagaggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggaacaaaggcaagcaaaagcccatgtccaggagccctgggtgtccccacaggctcgcctctgagagcctctttggggtgagcagccttgtattggccacaggtgcactaaattgactgtgaatcccaaacctccccagaccagccaggccgcctgcccccacccagaaccttccggtttgccctgtatggaaagccactctcggaaatccctctttcctgagtcagcaatcgtggcaaggggacatgtgttccaacagcggctggggagtggacctctctgtcccttgcccaccttaagccccaaatccggaccccctctgacatcactggcattgcacctgggtgtgcccccctccccacgctatggacccagataggaggggttaggcatgggggaggcacagaatgctggagagatgcgtcctggtgaacgtggggcagcccctcccacgacccccaccagactgccttaggttttgtcagccccactccctttccttcccctctgcctcccacccactctgggggtccacatcaagatagctgggcccagtgtggaagcccagcgtgtctgttctagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcacagtaattttttgtctgtatatatttgagggcctttttttaaaaaaaaaaaagaaaagaaaaatataattgttggatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaagcaaaaaaaaaaaaaagaggggggggttaagattttcccgaggggccaagttaggtacccgggttttggaaaggggccaaagggaggggttaaagaggagggggggtaaaagtggggggaacggcgtggtttggggacctttgggggtatggaccaggggtagcgaaaatagga

SEQ ID NO: 364814 - DNA, 4934 bp, Homo sapiens
agcggagtgggggggaggcggcggcagcggcagcggctgcgggcagcgcgcggggcgcagggcgcggggcgatcaccgtcggggctcgggaggcgggcagtgggcacaggctccccggtgcccgcccctccgctgcggaggggggccgcgagcgggcggccggggaggggccggcaccgccgccacaaaatgagcctgctgtcggccatcgacacgagcgccgcctcggtgtaccagcccgcccagctgctcaactgggtctacctgtcgctgcaggacacgcaccaggctagcgccttcgatgccttccggcccgagccgaccgccggcgccgcacccccggagctggccttcggcaagggccgccccgagcagctgggctcgcccctgcactccagctatctcaacagcttcttccagctgcagcgcggagaggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggaacaaaggcaagcaaaagcccatgtccaggagccctgggtgtccccacaggctcgcctctgagagcctctttggggtgagcagccttgtattggccacaggtgcactaaattgactgtgaatcccaaacctccccagaccagccaggccgcctgcccccacccagaaccttccggtttgccctgtatggaaagccactctcggaaatccctctttcctgagtcagcaatcgtggcaaggggacatgtgttccaacagcggctggggagtggacctctctgtcccttgcccaccttaagccccaaatccggaccccctctgacatcactggcattgcacctgggtgtgcccccctccccacgctatggacccagataggaggggttaggcatgggggaggcacagaatgctggagagatgcgtcctggtgaacgtggggcagcccctcccacgacccccaccagactgccttaggttttgtcagccccactccctttccttcccctctgcctcccacccactctgggggtccacatcaagatagctgggcccagtgtggaagcccagcgtgtctgttctagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcacagtaattttttgtctgtatatatttgagggcctttttttaaaaaaaaaaaagaaaagaaaaatataattgttggatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaagcaaaa

SEQ ID NO: 364815 - DNA, 414 bp, Homo sapiens
gtacaagtgtcccaagtgcaagagaaaatggatgagcgggaactcctgggccaacatggggcaggagtgcatcaagtgccacatcaacgtgtatccacacaagcaggtgagccgggcaggctggggccttctcagaaggaccgcgggagggcaacttttcccttaccggacctcagtttactccctcctacaagggagatctctctaagttgaccctttctttccttgtctcatctgaaatgggagggaagggaagggaaggaggatgatggggcaactgcaccaagatcttgagaccagagaaccccggggaattgtaaaactagtgaacagggtgtgctgttgtgagacagagatgtgcggacagcaggaagcagcagaaaactcaaatttccttccttgatccatccagtc

SEQ ID NO: 364816 - DNA, 330 bp, Homo sapiens
ggccttcgtcttacaaaaaaggttgtcaaccaataaatcagggcatggaatgttttccggagtcttgacctcgatttgtaacttggtgcagaagtctagattgtaatcttaattcagtttctaatttgctgtgtagccaggagcaagtcttttagcaccacccggttttctctgctatgacttgcttaccccacagaattactgagccttaaataaggtaatgaatgtaaactagctgaagaaacatgaagcaagtgcaaagcatcagtagaagtgttatgtgtacattttgaattctaaataacccaagaagtaacttagccatatata

SEQ ID NO: 364817 - DNA, 1427 bp, Homo sapiens
gcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcacaaagga

SEQ ID NO: 364818 - DNA, 606 bp, Homo sapiens
acgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggcaccgcaaaacaaaacaaaggcatagagaacggaaatccagccaggcgaggttcagtctgacgtacaggctcatgccccgagccgggctgagtccccgccctgggaggttggaggctgaggtccctggccctacccatactcccagcgcctcaggttgcccagggcccaaccaggagggcaggaaggtaacccccaggacaggtgatacccgccaggggccagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcacaaagga

SEQ ID NO: 364819 - DNA, 7634 bp, Homo sapiens
  misc_feature (2427)..(2427): n is a, c, g, or t
gcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggancctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacagggcactcccaggccctgtcgccattgaggtgcctccgctgggctgtctcctcacccctccctgtgctggagcctgtcccaaaaaggtgccaactgggaggcctcggaagccactgtccaggctcccactgcctgtctgctctgttcccaaaggcagcgtgtgtggcctcgggccctgcggtggcatgaagcatcccttctggtgtgggcatcgctacgtgttttgggggcagcgtttcacggcggtgcccttgctgtctcccttgggctggctcgagcctggggtccatgtccctttgccgtcccgtcatggggcagggaatccatagcggggcccacaggcaggggtatgagtgcgtcccacccaacgcagcaccagccccggccaccgctccccgtgtccccagttccgtctcagctacctggactccaggaccctggagaagggagacctggcagtggagggaggctgtgctgtgtgtccccctgcaggtgtgaccccgcctgctctttcctcccccgccaggtgtggccccgcctgctctttcctcccccaccagtatggccccacctgctctttcctccccccccaaggtgtggccccacctgttctttcctcccctgccgaggtgtgaccccacctgctctttcctccctcccagtatggccccacctgctctttcctcccccgaggtgaggccccgcctgctctttcctcccatgggagccgctgaggcgtgcgcacctgggcacaggttggggctctgcaggatgaggaagacaggccaatcccttccctcccagaagctggccgcccagcaggagggactgaggccagactcatgtccagcaaggaacgtgtggtgtgtcccctgggaagtctctgggccctgggaagagggaaggtgcacgtcctgggatggttgcggggccctgttttgggagacaaaggggtagagggtctgtcttgggcccccccagactctagcccgagcagtgcagccacctactgccccacctcagagaagtgcagcgggaaggaggctggaggtggtgcggcgctgcctcgggtgtctgcgtgaatgagcgtggccaaggaccagtgccacctcatggcaaagagctcccgcagtgtttgttagagtgcacatccctacgtgcccactggcacacacacgtgctcacatacatgtccgcgtacaggcgtacacatgcacgcttgcacacatgcacacagaccacatagcacacatgtgcactgaccacacctgtatagaccatgcacagtacacatacgtgcatacacatgcctgcatacaggcatacacatgcacgcttacatgtacacgtgcacagatcacacacatgcacacacgtgtagctcacacacagtatacacatacacaagtgcacagaccacacacagcactaacacatgcacacacaaagtgcataggccacacagcacatgcacacaggtgcacagaccacacagcacacacaagtgcacagagcacactgcacacatgcacacacacacgcgtgcatgcacactcctcgcacttccagccttggagcccttctgtctctggtctttctctttgaccctgctgagtgtaagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttcccccccacagcctggcagccatccagaggaggggctctaccagatgccaaggtgccccggtgtctgtatgggtgtccggttgggtcctgtgtttggtctgccctggaggtggctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcctcctgcacacagccgtctgagcagggcaggtgccaacaccccccaccggagacacgctgcccctcagcgatgcccctaccttttggggggcctcgtctcaagcccccccttggaggctgaaatcaccccaggcactgtgagggcttctccagggggacaccctttgagctgtgggtctgatcaccccaagtcccgcacacggaggagaggcacagccagggcgtgtggtttaatgtttgccccttcggggctggaggtctcagtgtttctagattccagaccctgctgccagagagacctgctgccggagagaaggggaggaggactccagctgggctcggtcccccacagtcagggacccccataaaggacacccccttctctctagaaagagctgggctctcagctatttctagttgcttcccagaagccgaggagcagaaggagctgtgagagctttgcagaaacgcccttgtccccgccctcctgagctatgaatgccgtacagagcagaggctggggcattggcaagatcacaggttgatgctgcacagccccattgacacaaaccctcaaagcagacgtgagagggacggttcacaaagctcggacctgccgtggagggtgcccggcagacgtggcgtgagagggacggctcacgaggcttggacctgctgtggagggtgcccagcagacgtggtgtgagaggaacggctcacgagacttggacctggtggagggtgcccagcagacgtggtgtgagagggacggctcacagggcttggacctgccatggagggtgcccggcagacgtggtgtgagagggatggttcacagggcttggacctgccatggagggtgcccggcagatgtggtcggagagagatggctcatgagacttggacctgccgtggagggtgcccagcagacgtggtatgagagggatggctcacgaggcttggacctggtggagggtgcccggcagacgtgtgagagggacggttcacaaggcttggacctgccatggagggtgcccagcagacgtggtgtgagagggacagctcacgaggcttggacctgccgtggagggtgcccagcagggggctgagctctgaggggtgggtgctcagtgcacgggtgcccccagtgtcctctgatcctgtccggtgcctcccccaacccccacacccatgcagaactcccaggtcacatgcacgtatgtccagggcatgggggtggcgtgaagaggcctggtcagggcctttaggggctgcaggacggaatggccacctggggagcctgtgtggctgtgccgggcagccatcctgcattcccacccagcgcgcagtctccacctcggccccagcaaagcgctaagcagccggagagacagccagggcggcttcctgaaggatgtgggatggtggactccggggtcgagggaatacgcaggttcctgtccctccgggagacctagagaagctgcacacccaggagctttccatgacccgggagcatgagtgaatgggggttccagtttgctgaactttgctgtcttgtaagggtgggggctgacggccgaccctgggaggaggtgacatcgcagggggaggttgtgggcaacggtggaggaggagagacgggaggggaccatttgggatggaggggcctcttcagagttttaaaaggcgtttgtggggtggagttgagtgtgctctgggcttggacacttgccgtggtgcccctggctggccgaggagactggctctggccagggccccgtcctgagaggtcctcagcgtctgactctcggccaggcgccagcaaggaggggccggtccccggggctaccaggcaggcacgtgcacatcgccatcgccacacgccaactccgcctgggttttacaaagtcgttgccttaatgcatgtggacaggaactccctgaggtcgccccatgccccctggctgtgccaggtacggacgccctggaccctgcgaacaggtggggcgggcgaggggcccaagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattcaacctg

SEQ ID NO: 364820 - DNA, 3561 bp, Homo sapiens
  misc_feature (2463)..(2463): n is a, c, g, or t
gcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggancctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcccggtggggtttccgggcagctacaggcgggtgtggccggccgctgtgcgtggcctctgccttcacacctgacctgcccggcgggctttcctgttccccacctcaggggcgcccaaatacagagctattggttggcgtcttctccctgtaaaacacaaaaaaaaaaaaaaaaaaaaaccccgcggggcttcttatggagcgcgggcggcggggaaacaagagaggtgtcacgagaattggcgccattggggcaataggctggttccctgagcccacagctcttctgggtccacagggggcgaaatcgggcgggcccccctaaagggggggccggatactcccgaaaacgccgggtacccgagg

SEQ ID NO: 364821 - DNA, 6578 bp, Homo sapiens
  misc_feature (1371)..(1371): n is a, c, g, or t
tggcctgctggcccagagtcctgagtgcctggcctacagcatgggggtcccctctgccccgttccctccacgcccggccctcctgggcgcgcccctcgccgcctgcccctcgccaactgccttgtctttccctccgcagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggancctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacagggcactcccaggccctgtcgccattgaggtgcctccgctgggctgtctcctcacccctccctgtgctggagcctgtcccaaaaaggtgccaactgggaggcctcggaagccactgtccaggctcccactgcctgtctgctctgttcccaaaggcagcgtgtgtggcctcgggccctgcggtggcatgaagcatcccttctggtgtgggcatcgctacgtgttttgggggcagcgtttcacggcggtgcccttgctgtctcccttgggctggctcgagcctggggtccatgtccctttgccgtcccgtcatggggcagggaatccatagcggggcccacaggcaggggtatgagtgcgtcccacccaacgcagcaccagccccggccaccgctccccgtgtccccagttccgtctcagctacctggactccaggaccctggagaagggagacctggcagtggagggaggctgtgctgtgtgtccccctgcaggtgtgaccccgcctgctctttcctcccccgccaggtgtggccccgcctgctctttcctcccccaccagtatggccccacctgctctttcctccccccccaaggtgtggccccacctgttctttcctcccctgccgaggtgtgaccccacctgctctttcctccctcccagtatggccccacctgctctttcctcccccgaggtgaggccccgcctgctctttcctcccatgggagccgctgaggcgtgcgcacctgggcacaggttggggctctgcaggatgaggaagacaggccaatcccttccctcccagaagctggccgcccagcaggagggactgaggccagactcatgtccagcaaggaacgtgtggtgtgtcccctgggaagtctctgggccctgggaagagggaaggtgcacgtcctgggatggttgcggggccctgttttgggagacaaaggggtagagggtctgtcttgggcccccccagactctagcccgagcagtgcagccacctactgccccacctcagagaagtgcagcgggaaggaggctggaggtggtgcggcgctgcctcgggtgtctgcgtgaatgagcgtggccaaggaccagtgccacctcatggcaaagagctcccgcagtgtttgttagagtgcacatccctacgtgcccactggcacacacacgtgctcacatacatgtccgcgtacaggcgtacacatgcacgcttgcacacatgcacacagaccacatagcacacatgtgcactgaccacacctgtatagaccatgcacagtacacatacgtgcatacacatgcctgcatacaggcatacacatgcacgcttacatgtacacgtgcacagatcacacacatgcacacacgtgtagctcacacacagtatacacatacacaagtgcacagaccacacacagcactaacacatgcacacacaaagtgcataggccacacagcacatgcacacaggtgcacagaccacacagcacacacaagtgcacagagcacactgcacacatgcacacacacacgcgtgcatgcacactcctcgcacttccagccttggagcccttctgtctctggtctttctctttgaccctgctgagtgtaagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttcccccccacagcctggcagccatccagaggaggggctctaccagatgccaaggtgccccggtgtctgtatgggtgtccggttgggtcctgtgtttggtctgccctggaggtggctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcctcctgcacacagccgtctgagcagggcaggtgccaacaccccccaccggagacacgctgcccctcagcgatgcccctaccttttggggggcctcgtctcaagcccccccttggaggctgaaatcaccccaggcactgtgagggcttctccagggggacaccctttgagctgtgggtctgatcaccccaagtcccgcacacggaggagaggcacagccagggcgtgtggtttaatgtttgccccttcggggctggaggtctcagtgtttctagattccagaccctgctgccagagagacctgctgccggagagaaggggaggaggactccagctgggctcggtcccccacagtcagggacccccataaaggacacccccttctctctagaaagagctgggctctcagctatttctagttgcttcccagaagccgaggagcagaaggagctgtgagagctttgcagaaacgcccttgtccccgccctcctgagctatgaatgccgtacagagcagaggctggggcattggcaagatcacaggttgatgctgcacagccccattgacacaaaccctcaaagcagacgtgagagggacggttcacaaagctcggacctgccgtggagggtgcccggcagacgtggcgtgagagggacggctcacgaggcttggacctgctgtggagggtgcccagcagacgtggtgtgagaggaacggctcacgagacttggacctggtggagggtgcccagcagacgtggtgtgagagggacggctcacagggcttggacctgccatggagggtgcccggcagacgtggtgtgagagggatggttcacagggcttggacctgccatggagggtgcccggcagatgtggtcggagagagatggctcatgagacttggacctgccgtggagggtgcccagcagacgtggtatgagagggatggctcacgaggcttggacctggtggagggtgcccggcagacgtgtgagagggacggttcacaaggcttggacctgccatggagggtgcccagcagacgtggtgtgagagggacagctcacgaggcttggacctgccgtggagggtgcccagcagggggctgagctctgaggggtgggtgctcagtgcacgggtgcccccagtgtcctctgatcctgtccggtgcctcccccaacccccacacccatgcagaactcccaggtcacatgcacgtatgtccagggcatgggggtggcgtgaagaggcctggtcagggcctttaggggctgcaggacggaatggccacctggggagcctgtgtggctgtgccgggcagccatcctgcattcccacccagcgcgcagtctccacctcggccccagcaaagcgctaagcagccggagagacagccagggcggcttcctgaaggatgtgggatggtggactccggggtcgagggaatacgcaggttcctgtccctccgggagacctagagaagctgcacacccaggagctttccatgacccgggagcatgagtgaatgggggttccagtttgctgaactttgctgtcttgtaagggtgggggctgacggccgaccctgggaggaggtgacatcgcagggggaggttgtgggcaacggtggaggaggagagacgggaggggaccatttgggatggaggggcctcttcagagttttaaaaggcgtttgtggggtggagttgagtgtgctctgggcttggacacttgccgtggtgcccctggctggccgaggagactggctctggccagggccccgtcctgagaggtcctcagcgtctgactctcggccaggcgccagcaaggaggggccggtccccggggctaccaggcaggcacgtgcacatcgccatcgccacacgccaactccgcctgggttttacaaagtcgttgccttaatgcatgtggacaggaactccctgaggtcgccccatgccccctggctgtgccaggtacggacgccctggaccctgcgaacaggtggggcgggcgaggggcccaagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattcaacctg

SEQ ID NO: 364822 - DNA, 535 bp, Homo sapiens
acgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggcaccgcaaaacaaaacaaaggcatagagaacggaaatccagccaggcgaggttcagtctgacgtacaggctcatgccccgagccgggctgagtccccgccctgggaggttggaggctgaggtccctggccctacccatactcccagcgcctcaggttgcccagggcccaaccaggagggcaggaaggtaacccccaggacaggtgatacccgccaggggccaggtaagagtcatgaaaaggaaagaacacagcctccctgcgagctcgctcagggccccgagtcaagccccaaccgctcccctccttcaggccccaccgtctgacaagcgggcttgcctgtctgtcctacagagggtaaactgaggctgtggggctga

SEQ ID NO: 364823 - DNA, 811 bp, Homo sapiens
agacggggaaggccgtgcagcttgcgatgcccttggcaggaaatgcccggggcggggaagtccgtggagccccgtacaccctggcggtggccagggcctgggggaccaggaaccaggagcgcctgctgaacgtcgggggtaggagggggtttatttgggggcgacgaagaggtgtggagttagataggggcagtggtcgcacagcactgtgtgtgcaggcgctactgaagtgcacgctttaacatggctaacatggtgaacttcaggatatgtctatttcagcaccgcaaaacaaaacaaaggcatagagaacggaaatccagccaggcgaggttcagtctgacgtacaggctcatgccccgagccgggctgagtccccgccctgggaggttggaggctgaggtccctggccctacccatactcccagcgcctcaggttgcccagggcccaaccaggagggcaggaaggtaacccccaggacaggtgatacccgccaggggccaggtaagagtcatgaaaaggaaagaacacagcctccctgcgagctcgctcagggccccgagtcaagccccaaccgctcccctccttcaggccccaccgtctgacaagcgggcttgcctgtctgtcctacagagggtaaactgaggctgtggggctgatgcagcactggggcctggcctgctggcccagagtcctgagtgcctggcctacagcatgggggtcccctctgccccgttccctccacgcccggccctcctgggcgcgcccctcgccgcctgcccctcgccaactgccttgtctttccctccg

SEQ ID NO: 364824 - DNA, 858 bp, Homo sapiens
  misc_feature (758)..(758): n is a, c, g, or t
ccccatctcctaggaccagcctgggtcccccccatttcctgggactagcctgggtcccccatttcctgggactagcctgggtctctcctgtttcctggaaccagcctgggcccccccatttcctgggagcagcccgggtccccacatctcctgggactagcctgggtcccccgtttcctgggactagcctgggtctctcctgtttcctggaaccagcctgggcccccccatttcctgggagcagcctgggtccccacatctcctgggacgggccctcgcaccccagcccagcagccccttttgcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggancctgcgggacagcgacacgtccatctccatcccgtccgtggaccacgaggagctggagcgttccttcagcggcttcagcatctcccagtccaaggagaac

SEQ ID NO: 364825 - DNA, 7551 bp, Homo sapiens
  misc_feature (2433)..(2433): n is a, c, g, or t
gcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggancctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacagggcactcccaggccctgtcgccattgaggtgcctccgctgggctgtctcctcacccctccctgtgctggagcctgtcccaaaaaggtgccaactgggaggcctcggaagccactgtccaggctcccactgcctgtctgctctgttcccaaaggcagcgtgtgtggcctcgggccctgcggtggcatgaagcatcccttctggtgtgggcatcgctacgtgttttgggggcagcgtttcacggcggtgcccttgctgtctcccttgggctggctcgagcctggggtccatgtccctttgccgtcccgtcatggggcagggaatccatagcggggcccacaggcaggggtatgagtgcgtcccacccaacgcagcaccagccccggccaccgctccccgtgtccccagttccgtctcagctacctggactccaggaccctggagaagggagacctggcagtggagggaggctgtgctgtgtgtccccctgcaggtgtgaccccgcctgctctttcctcccccgccaggtgtggccccgcctgctctttcctcccccaccagtatggccccacctgctctttcctccccccccaaggtgtggccccacctgttctttcctcccctgccgaggtgtgaccccacctgctctttcctccctcccagtatggccccacctgctctttcctcccccgaggtgaggccccgcctgctctttcctcccatgggagccgctgaggcgtgcgcacctgggcacaggttggggctctgcaggatgaggaagacaggccaatcccttccctcccagaagctggccgcccagcaggagggactgaggccagactcatgtccagcaaggaacgtgtggtgtgtcccctgggaagtctctgggccctgggaagagggaaggtgcacgtcctgggatggttgcggggccctgttttgggagacaaaggggtagagggtctgtcttgggcccccccagactctagcccgagcagtgcagccacctactgccccacctcagagaagtgcagcgggaaggaggctggaggtggtgcggcgctgcctcgggtgtctgcgtgaatgagcgtggccaaggaccagtgccacctcatggcaaagagctcccgcagtgtttgttagagtgcacatccctacgtgcccactggcacacacacgtgctcacatacatgtccgcgtacaggcgtacacatgcacgcttgcacacatgcacacagaccacatagcacacatgtgcactgaccacacctgtatagaccatgcacagtacacatacgtgcatacacatgcctgcatacaggcatacacatgcacgcttacatgtacacgtgcacagatcacacacatgcacacacgtgtagctcacacacagtatacacatacacaagtgcacagaccacacacagcactaacacatgcacacacaaagtgcataggccacacagcacatgcacacaggtgcacagaccacacagcacacacaagtgcacagagcacactgcacacatgcacacacacacgcgtgcatgcacactcctcgcacttccagccttggagcccttctgtctctggtctttctctttgaccctgctgagtgtaagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttcccccccacagcctggcagccatccagaggaggggctctaccagatgccaaggtgccccggtgtctgtatgggtgtccggttgggtcctgtgtttggtctgccctggaggtggctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcctcctgcacacagccgtctgagcagggcaggtgccaacaccccccaccggagacacgctgcccctcagcgatgcccctaccttttggggggcctcgtctcaagcccccccttggaggctgaaatcaccccaggcactgtgagggcttctccagggggacaccctttgagctgtgggtctgatcaccccaagtcccgcacacggaggagaggcacagccagggcgtgtggtttaatgtttgccccttcggggctggaggtctcagtgtttctagattccagaccctgctgccagagagacctgctgccggagagaaggggaggaggactccagctgggctcggtcccccacagtcagggacccccataaaggacacccccttctctctagaaagagctgggctctcagctatttctagttgcttcccagaagccgaggagcagaaggagctgtgagagctttgcagaaacgcccttgtccccgccctcctgagctatgaatgccgtacagagcagaggctggggcattggcaagatcacaggttgatgctgcacagccccattgacacaaaccctcaaagcagacgtgagagggacggttcacaaagctcggacctgccgtggagggtgcccggcagacgtggcgtgagagggacggctcacgaggcttggacctgctgtggagggtgcccagcagacgtggtgtgagaggaacggctcacgagacttggacctggtggagggtgcccagcagacgtggtgtgagagggacggctcacagggcttggaccggagagagatggctcatgagacttggacctgccgtggagggtgcccagcagacgtggtatgagagggatggctcacgaggcttggacctggtggagggtgcccggcagacgtgtgagagggacggttcacaaggcttggacctgccatggagggtgcccagcagacgtggtgtgagagggacagctcacgaggcttggacctgccgtggagggtgcccagcagggggctgagctctgaggggtgggtgctcagtgcacgggtgcccccagtgtcctctgatcctgtccggtgcctcccccaacccccacacccatgcagaactcccaggtcacatgcacgtatgtccagggcatgggggtggcgtgaagaggcctggtcagggcctttaggggctgcaggacggaatggccacctggggagcctgtgtggctgtgccgggcagccatcctgcattcccacccagcgcgcagtctccacctcggccccagcaaagcgctaagcagccggagagacagccagggcggcttcctgaaggatgtgggatggtggactccggggtcgagggaatacgcaggttcctgtccctccgggagacctagagaagctgcacacccaggagctttccatgacccgggagcatgagtgaatgggggttccagtttgctgaactttgctgtcttgtaagggtgggggctgacggccgaccctgggaggaggtgacatcgcagggggaggttgtgggcaacggtggaggaggagagacgggaggggaccatttgggatggaggggcctcttcagagttttaaaaggcgtttgtggggtggagttgagtgtgctctgggcttggacacttgccgtggtgcccctggctggccgaggagactggctctggccagggccccgtcctgagaggtcctcagcgtctgactctcggccaggcgccagcaaggaggggccggtccccggggctaccaggcaggcacgtgcacatcgccatcgccacacgccaactccgcctgggttttacaaagtcgttgccttaatgcatgtggacaggaactccctgaggtcgccccatgccccctggctgtgccaggtacggacgccctggaccctgcgaacaggtggggcgggcgaggggcccaagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattcaacctg

SEQ ID NO: 364826 - DNA, 651 bp, Homo sapiens
  misc_feature (241)..(241): n is a, c, g, or t
caggtttacaatgttagaattttaaccgcccccaataggatttggccctgagccaaaaaattggggcgagggggttttcccccacccccgaggtgctccaaaggaaaagggtcccccgcagcccagtttgtgggggtccccccggccccacaaaattctgagcacccccccaagagggacagagtggagttggggccccaaaacgcggccccccctttctctcataggggccgctcgggcnaaaatcttaaaaaagacacctccccggggaacttggggaacaaaccggccttggagtttgccaggggcctttcccccggccataaagcagatcaaacgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggcaagagccccgcctgcctgtccagcaggggacaagaacggggtgggcttctgggacaaagcccactgtggcccatggtgggagtgcagggggtgtgtgggcggggcctcctccccacccacgtcggcctctgtcagcttctgttgtgtcttcacaaagtctgttttaatatttct

SEQ ID NO: 364827 - DNA, 6987 bp, Homo sapiens
  misc_feature (2427)..(2427): n is a, c, g, or t
gcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggancctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacagggcactcccaggccctgtcgccattgaggtgcctccgctgggctgtctcctcacccctccctgtgctggagcctgtcccaaaaaggtgccaactgggaggcctcggaagccactgtccaggctcccactgcctgtctgctctgttcccaaaggcagcgtgtgtggcctcgggccctgcggtggcatgaagcatcccttctggtgtgggcatcgctacgtgttttgggggcagcgtttcacggcggtgcccttgctgtctcccttgggctggctcgagcctggggtccatgtccctttgccgtcccgtcatggggcagggaatccatagcggggcccacaggcaggggtatgagtgcgtcccacccaacgcagcaccagccccggccaccgctccccgtgtccccagttccgtctcagctacctggactccaggaccctggagaagggagacctggcagtggagggaggctgtgctgtgtgtccccctgcaggtgtgaccccgcctgctctttcctcccccgccaggtgtggccccgcctgctctttcctcccccaccagtatggccccacctgctctttcctccccccccaaggtgtggccccacctgttctttcctcccctgccgaggtgtgaccccacctgctctttcctccctcccagtatggccccacctgctctttcctcccccgaggtgaggccccgcctgctctttcctcccatgggagccgctgaggcgtgcgcacctgggcacaggttggggctctgcaggatgaggaagacaggccaatcccttccctcccagaagctggccgcccagcaggagggactgaggccagactcatgtccagcaaggaacgtgtggtgtgtcccctgggaagtctctgggccctgggaagagggaaggtgcacgtcctgggatggttgcggggccctgttttgggagacaaaggggtagagggtctgtcttgggcccccccagactctagcccgagcagtgcagccacctactgccccacctcagagaagtgcagcgggaaggaggctggaggtggtgcggcgctgcctcgggtgtctgcgtgaatgagcgtggccaaggaccagtgccacctcatggcaaagagctcccgcagtgtttgttagagtgcacatccctacgtgcccactggcacacacacgtgctcacatacatgtccgcgtacaggcgtacacatgcacgcttgcacacatgcacacagaccacatagcacacatgtgcactgaccacacctgtatagaccatgcacagtacacatacgtgcatacacatgcctgcatacaggcatacacatgcacgcttacatgtacacgtgcacagatcacacacatgcacacacgtgtagctcacacacagtatacacatacacaagtgcacagaccacacacagcactaacacatgcacacacaaagtgcataggccacacagcacatgcacacaggtgcacagaccacacagcacacacaagtgcacagagcacactgcacacatgcacacacacacgcgtgcatgcacactcctcgcacttccagccttggagcccttctgtctctggtctttctctttgaccctgctgagtgtaagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttcccccccacagcctggcagccatccagaggaggggctctaccagatgccaaggtgccccggtgtctgtatgggtgtccggttgggtcctgtgtttggtctgccctggaggtggctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcctcctgcacacagccgtctgagcagggcaggtgccaacaccccccaccggagacacgctgcccctcagcgatgcccctaccttttggggggcctcgtctcaagcccccccttggaggctgaaatcaccccaggcactgtgagggcttctccagggggacaccctttgagctgtgggtctgatcaccccaagtcccgcacacggaggagaggcacagccagggcgtgtggtttaatgtttgccccttcggggctggaggtctcagtgtttctagattccagaccctgctgccagagagacctgctgccggagagaaggggaggaggactccagctgggctcggtcccccacagtcagggacccccataaaggacacccccttctctctagaaagagctgggctctcagctatttctagttgcttcccagaagccgaggagcagaaggagctgtgagagctttgcagaaacgcccttgtccccgccctcctgagctatgaatgccgtacagagcagaggctggggcattggcaagatcacaggttgatgctgcacagccccattgacacaaaccctcaaagcagacgtgagagggacggttcacaaagctcggacctgccgtggagggtgcccggcagacgtggcgtgagagggacggctcacgaggcttggacctgctgtggagggtgcccagcagacgtggtgtgagaggaacggctcacgagacttggacctggtggagggtgcccagcagacgtggtgtgagagggacggctcacagggcttggacctgccatggagggtgcccggcagacgtggtgtgagagggatggttcacagggcttggacctgccatggagggtgcccggcagatgtggtcggagagagatggctcatgagacttggacctgccgtggagggtgcccagcagacgtggtatgagagggatggctcacgaggcttggacctggtggagggtgcccggcagacgtgtgagagggacggttcacaaggcttggacctgccatggagggtgcccagcagacgtggtgtgagagggacagctcacgaggcttggacctgccgtggagggtgcccagcagggggctgagctctgaggggtgggtgctcagtgcacgggtgcccccagtgtcctctgatcctgtccggtgcctcccccaacccccacacccatgcagaactcccaggtcacatgcacgtatgtccagggcatgggggtggcgtgaagaggcctggtcagggcctttaggggctgcaggacggaatggccacctggggagcctgtgtggctgtgccgggcagccatcctgcattcccacccagcgcgcagtctccacctcggccccagcaaagcgctaagcagccggagagacagccagggcggcttcctgaaggatgtgggatggtggactccggggtcgagggaatacgcaggttcctgtccctccgggagacctagagaagctgcacacccaggagctttccatgacccgggagcatgagtgaatgggggttccagtttgctgaactttgctgtcttgtaagggtgggggctgttggtgtggcttgactgtgccgaaccctgtgtgagtgacggttgaccatctgcctgtgtgtgtgatgtgtttgttgtggcaactgtgtggatgtgatgtgcagatgactgtgcgatgggtggacccatttggggattggatgtgtggccctcattcagaaagtttctaaaaatgggcggttttgttgcggtgttgggagattgagttgtggctcttggtgctatgtgagcactatgtcctgttgtgtgtcgccctgtgtctgtgcgctgatgtgatgacttgtgctcttggcgcaggggtgcccccctggtccttgatggagtggtcctcaagctgtctaggagtcctctggggcatgtgctgtccagcaatggatggggcctgtgtcccccgggggcgtacacagggcatggcgacgtgcacattcgccatctgcaca

SEQ ID NO: 364828 - DNA, 3615 bp, Homo sapiens
  misc_feature (2517)..(2517): n is a, c, g, or t
gcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggancctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcccggtggggtttccgggcagctacaggcgggtgtggccggccgctgtgcgtggcctctgccttcacacctgacctgcccggcgggctttcctgttccccacctcaggggcgcccaaatacagagctattggttggcgtcttctccctgtaaaacacaaaaaaaaaaaaaaaaaaaaaccccgcggggcttcttatggagcgcgggcggcggggaaacaagagaggtgtcacgagaattggcgccattggggcaataggctggttccctgagcccacagctcttctgggtccacagggggcgaaatcgggcgggcccccctaaagggggggccggatactcccgaaaacgccgggtacccgagg

SEQ ID NO: 364829 - DNA, 1342 bp, Homo sapiens
gcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccaggtgagtccaggtgtcccccggggaccagcacagcccttgtcctggtcccaccttgttgaggagtggaggccgctggggctttggcattgccctgtctgtggatgggccacagcgctcaccctctgcaggaatctgtggaag

SEQ ID NO: 364830 - DNA, 914 bp, Homo sapiens
cctgagcaacatggagaaaccctgtctctactaaaaattcaaaattagtcaggcgtggtggcacatgcctgtaatctcagctattccggaggctgaggcaggagagaacacttgaacccgggaggcggaggttgtggtgagccaagattgtgccattgccctccagcctgggcaacaagagcaaaactctgtctcaaaaataaaaaaaataaacaattgaatacaaggatttttaatatctgcctaatacttatgccttcatcgcattaatgtgctacgcttgatttaattgttcccttttgatattcagtttatttccagtttgatgctgcaataccactgtgctgaacgtctctggcacattcatcttggttgcaattgtactttaggctatatttctaagagtgaaatgaccacagccaaaggtatgaacattgttcaggctttcaataaagactgccagatatttacaaagattgtgccaatctctattctcaccaccgcttttgattattgtccttatctctgcttgccactgagccccgggccatgtctctgtaactcactaacggccacatcccatttacttccccatgagtaggatttcagtttcccaaacctgagatgatctgtcagctggagaactgggacgagcagtggatcctggatctaccgagaactgggaataggaaggcttccggtagtgcttgcccaggtgggtgaggaagagacccaggcgagtggaatcaggaagaggaagggaaggcatgttagtgaagccccttctgtgtgccagacgctgagccaggtgctgggcatatattatcccacttcttcatccctactgccctgtgaagtgggaggaagatcggcgtccccatttcccagatgaagaaactaagattaagaaatct

SEQ ID NO: 364831 - DNA, 965 bp, Homo sapiens
agccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctgggatttcagtttcccaaacctgagatgatctgtcagctggagaactgggacgagcagtggatcctggatctaccgagaactgggaataggaaggcttccggtagtgcttgcccaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgatgaatacagcaggggcttccttcaaaaccttaaccttattcaagatcagaatgcgcaaacaaggtggaagcagggcagatatgatgaggatggcaaacccttcaatcaaagatctttgcttttggggcatgagcgaattctcacaagagcaaagtcttatgaatgcagtgaatgtggaaaagtcattaggcgtaaggcatggtttgatcaacatcaaagaattcactttttagagaatccttttgagtgtaaggtctgtgggcaagccttcagacagcggtcagctcttacggtcca

SEQ ID NO: 364832 - DNA, 887 bp, Homo sapiens
agccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcaggagctgctctcgtttgaggatgtggcgatgtacttcaccagagaggagtggggccacctcaactggggtcagaaggacctctaccgagatgtgatgttggagaactacaggaacatggtcttgctgggatttcagtttcccaaacctgagatgatctgtcagctggagaactgggacgagcagtggatcctggatctaccgagaactgggaataggaaggcttccggtagtgcttgcccaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgatgaatacagcaggggcttccttcaaaaccttaaccttattcaagatcagaatgcgcaaacaaggtggaagcagggcagatatgatgaggatggcaaacccttcaatcaaagatctttgcttttggggcatgagcgaattctcacaagagcaaagtcttatgaatgcagtgaatgtggaaaagtcattaggcgtaaggcatggtttgatcaacatcaaagaattcactttttagagaatccttttgagtgtaaggtctgtgggcaagccttcagacagcggtcagctcttacggtcca

SEQ ID NO: 364833 - DNA, 743 bp, Homo sapiens
agccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctgggtaggacacggcttgaagattgggctttgtctgtgttctgagtgtctgtgcaagcccttagtcccttatctgcaattccagaatcagaaaaagcggtgaaaaccgaaaggtttttttataactcgtgtggctacaagccctgaccagacatcaccacagtgaaacctgacttcatcctataggaaaccatttattgtctttatttttccaacttggtgtgcatatctgtatacccaacttcagaaataacagtgtaggccaggtgcggtggctcacacctgtaatccc

SEQ ID NO: 364834 - DNA, 528 bp, Homo sapiens
gtccgagccggtggccgagctccggcaagggcgggaaccttcaggattaaatagacagggtctggctctgtcgcccaggctggactgcagtggcgcgatttcggctcactgcaacttctgtctcccgggttcaagcaattctccagcttcagcctcccaagtatctaggactacaggcggactctcgctctgtcgccaggctgtcttagcctcctgagtagcttggactacaggcgcgcgccaccatgcccggctactttctgtattttagtagagatggggtttcaccatgttggtcaggctggtctggaactcctgacctcgtgatccgcctgccccggcctcccaaagtgctgggattacaggcgtgagccgctgcgcccagttggaaaaagttttgttttttttttaaaactaagtgcttccatgtacatcagatgttaacgactttgatcctaacaaacaaacaaaaaagatgaggaaattgaggctcaaagatgtgtcctggcctggctcagtggcgtatgc

SEQ ID NO: 364835 - DNA, 472 bp, Homo sapiens
tcattgagcgtaagttattttaagaattgcagttacctttatcagctacttttccaggagctgctctcgtttgaggatgtggcgatgtacttcaccagagaggagtggggccacctcaactggggtcagaaggacctctaccgagatgtgatgttggagaactacaggaacatggtcttgctgggtaggacacggcttgaagattgggctttgtctgtgttctgagtgtctgtgcaagcccttagtcccttatctgcaattccagaatcagaaaaagcggtgaaaaccgaaaggtttttttataactcgtgtggctacaagccctgaccagacatcaccacagtgaaacctgacttcatcctataggaaaccatttattgtctttatttttccaacttggtgtgcatatctgtatacccaacttcagaaataacagtgtaggccaggtgcggtggctcacacctgtaatccc

SEQ ID NO: 364836 - DNA, 439 bp, Homo sapiens
gaggatctcggttgagatggagaccaggcttgagatggagaccgggaatgcagatggctgagtaggtcagattgaggacatggcagcgcagctctggtaaaagagtgacactctggataatggtgagaaagggcctgcaaccgtagcagtggaactcaggtttgataggcaggaaagaaagtccgtataatttgggaggttctggtgcctgcctgcagaggggagctacgtgaagcttctcaggatggtctcaggatgggggtgggcatttcctgttactgaccacttataggacagcgaacgtttgccctttccctgcacacatcccctctgaacccatgcagtgtcttgtgagagcaaggagtgtgtagacagccgctgggcccctttgcccagagggctgcagtggtgtgggagggagagtgtggcagcttcagtg

SEQ ID NO: 364837 - DNA, 1133 bp, Homo sapiens
agccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctggtttatttccagtttgatgctgcaataccactgtgctgaacgtctctggcacattcatcttggttgcaattgtactttaggctatatttctaagagtgaaatgaccacagccaaaggtatgaacattgttcaggctttcaataaagactgccagatatttacaaagattgtgccaatctctattctcaccaccgcttttgattattgtccttatctctgcttgccactgagccccgggccatgtctctgtaactcactaacggccacatcccatttacttccccatgagtaggatttcagtttcccaaacctgagatgatctgtcagctggagaactgggacgagcagtggatcctggatctaccgagaactgggaataggaaggcttccggtagtgcttgcccaggcggactctcgctctgtcgccaggctgtcttagcctcctgagtagcttggactacaggcgcgcgccaccatgcccggctactttctgtattttagtagagatggggtttcaccatgttggtcaggctggtctggaactcctgacctcgtgatccgcctgccccggcctcccaaagtgctgggattacaggcgtgagccgctgcgcccagttggaaaaagttttgttttttttttaaaactaagtgcttccatgtacatcagatgttaacgactttgatcctaacaaacaaacaaaaaagatgaggaaattgaggctcaaagatgtgtcctggcctggctcagtggcgtatgc

SEQ ID NO: 364838 - DNA, 1664 bp, Homo sapiens
gaggtgcagagtatgacatgttctagggagaaggggagggcagggctgcaggttctcttggatggagcttgggaaattgaaattactagacttattgtagcggtcatgcctggaatcccagcactttgggaggctgaggggggtggattgcctgaggtcaggagtttgagaccagcctggccaacatatagtgaaactccatctctactaaaaatacaaaaattagctgggtatagtggcgcatgcctataatcccatctacttgggaagctgaggcaggagaattgcttgaaccgaggaggtggaggttgcagtgagccgagatcgcgccattgcactctagcctgggcaacaagagcgaaactgtctcaaaaaacaaaaacgaaaacaaaaacccaaacaaacaaaaaatggaacttttaagcaacatttggtgcccatctgtcaatgtacaagtcctagctgttgatgggttcttggaaactgcaactttaagggaaactatgtatatcaaaaccgttttttttccatcagtgttacagtgaaacaaagttattcaaggacctgctgctgtacatacttttgctaaaaatcagtttccaagaacctattgtggatgttaggagaggagttaccatgccacaatgactctgggagatgaagccattttattcccatgcttgttaaccttgtgcaggtgcgggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctggtttatttccagtttgatgctgcaataccactgtgctgaacgtctctggcacattcatcttggttgcaattgtactttaggctatatttctaagagtgaaatgaccacagccaaaggtatgaacattgttcaggctttcaataaagactgccagatatttacaaagattgtgccaatctctattctcaccaccgcttttgattattgtccttatctctgcttgccactgagccccgggccatgtctctgtaactcactaacggccacatcccatttacttccccatgagtaggatttcagtttcccaaacctgagatgatctgtcagctggagaactgggacgagcagtggatcctggatctaccgagaactgggaataggaaggcttccggtagtgcttgcccaggcggactctcgctctgtcgccaggctgtcttagcctcctgagtagcttggactacaggcgcgcgccaccatgcccggctactttctgtattttagtagagatggggtttcaccatgttggtcaggctggtctggaactcctgacctcgtgatccgcctgccccggcctcccaaagtgctgggattacaggcgtgagccgctgcgcccagttggaaaaagttttgttttttttttaaaactaagtgcttccatgtacatcagatgttaacgactttgatcctaacaaacaaacaaaaaagatgaggaaattgaggctcaaagatgtgtcctggcctggctcagtggcgtatgc

SEQ ID NO: 364839 - DNA, 1212 bp, Homo sapiens
agccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctggtttatttccagtttgatgctgcaataccactgtgctgaacgtctctggcacattcatcttggttgcaattgtactttaggctatatttctaagagtgaaatgaccacagccaaaggtatgaacattgttcaggctttcaataaagactgccagatatttacaaagattgtgccaatctctattctcaccaccgcttttgattattgtccttatctctgcttgccactgagccccgggccatgtctctgtaactcactaacggccacatcccatttacttccccatgagtaggatttcagtttcccaaacctgagatgatctgtcagctggagaactgggacgagcagtggatcctggatctaccgagaactgggaataggaaggcttccggtagtgcttgcccaggcggactctcgctctgtcgccaggctgtcttagcctcctgagtagcttggactacaggcgcgcgccaccatgcccggctactttctgtattttagtagagatggggtttcaccatgttggtcaggctggtctggaactcctgacctcgtgatccgcctgccccggcctcccaaagtgctgggattacaggcgtgagccgctgcgcccagttggaaaaagttttgttttttttttaaaactaagtgcttccatgtacatcagatgttaacgactttgatcctaacaaacaaacaaaaaagatgaggaaattgaggctcaaagatgtgtcctggcctggctcagtggcgtatgc

SEQ ID NO: 364840 - DNA, 1097 bp, Homo sapiens
gaggtgcagagtatgacatgttctagggagaaggggagggcagggctgcaggttctcttggatggagcttgggaaattgaaattactagacttattgtagcggtcatgcctggaatcccagcactttgggaggctgaggggggtggattgcctgaggtcaggagtttgagaccagcctggccaacatatagtgaaactccatctctactaaaaatacaaaaattagctgggtatagtggcgcatgcctataatcccatctacttgggaagctgaggcaggagaattgcttgaaccgaggaggtggaggttgcagtgagccgagatcgcgccattgcactctagcctgggcaacaagagcgaaactgtctcaaaaaacaaaaacgaaaacaaaaacccaaacaaacaaaaaatggaacttttaagcaacatttggtgcccatctgtcaatgtacaagtcctagctgttgatgggttcttggaaactgcaactttaagggaaactatgtatatcaaaaccgttttttttccatcagtgttacagtgaaacaaagttattcaaggacctgctgctgtacatacttttgctaaaaatcagtttccaagaacctattgtggatgttaggagaggagttaccatgccacaatgactctgggagatgaagccattttattcccatgcttgttaaccttgtgcaggtgcgggaatgcagatggctgagtaggtcagattgaggacatggcagcgcagctctggtaaaagagtgacactctggataatggtgagaaagggcctgcaaccgtagcagtggaactcaggtttgataggcaggaaagaaagtccgtataatttgggaggttctggtgcctgcctgcagaggggagctacgtgaagcttctcaggatggtctcaggatgggggtgggcatttcctgttactgaccacttataggacagcgaacgtttgccctttccctgcacacatcccctctgaacccatgcagtgtcttgtgagagcaaggagtgtgtagacagccgctgggcccctttgcccagagggctgcagtggtgtgggagggagagtgtggcagcttcagtg

SEQ ID NO: 364841 - DNA, 309 bp, Homo sapiens
tctaggcgcctgatggggtgaggtgcatctcgctggtttatcgtcctagccccgcccgacgcagagggtcttgacggtttcccgcatcccgaggaaatacgggcgtccgagccggtggccgagctccggcaagggcgggaaccttcaggattaaatagacagggtctggctctgtcgcccaggctggactgcagtggcgcgatttcggctcactgcaacttctgtctcccgggttcaagcaattctccagcttcagcctcccaagtatctaggactacaggtgcgcgcgaccacgcccggtttattaat

SEQ ID NO: 364842 - DNA, 342 bp, Homo sapiens
acatgttccaacaccaaacacagggactttgtattaagctttgtctgtgtgccccgttggaattccgggtcccagatctgccaaccaagagagcttcaaattagggctggccttactgactttttttcttctccagctcagccagacgtccaggatcccaccccttgcaaaagaccaggccgtggaagccatgttcccaccagccagggggaaggtgagctgtgcctccccctctgcttcatcagcatagtcactgccaccagcagctccttcctcagactgagccctcttgatcaatgtggggagttttccttcttagacagtgcaatgtagagagcttag

SEQ ID NO: 364843 - DNA, 522 bp, Homo sapiens
ggtcgggagttcgagaccagcctgagcaacatggagaaaccctgtctctactaaaaattcaaaattagtcaggcgtggtggcacatgcctgtaatctcagctattccggaggctgaggcaggagagaacacttgaacccgggaggcggaggttgtggtgagccaagattgtgccattgccctccagcctgggcaacaagagcaaactctgtctcaaaaataaaaaaaatttggatcatgctatatatgagttttgtattctgctttaaaatacataggcagtgttttcctattttaataaatagttgggctgggcacggtggctcacgcctgtaatcccagcactttgggaggccgagacaggtggatcacctgaggtcaggagttcgagaccagttggccaacatggtgaaacctcgtctctattaaaaatgtaaaaattagctgggcgtggtggccacatgcctgtaattccagctacttgggaggccgaggcaagagaatcacttgaacccgggaggcg

SEQ ID NO: 364844 - DNA, 1159 bp, Homo sapiens
agccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctggtttatttccagtttgatgctgcaataccactgtgctgaacgtctctggcacattcatcttggttgcaattgtactttaggctatatttctaagagtgaaatgaccacagccaaaggatttcagtttcccaaacctgagatgatctgtcagctggagaactgggacgagcagtggatcctggatctaccgagaactgggaataggaaggcttccggtagtgcttgcccaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgatgaatacagcaggggcttccttcaaaaccttaaccttattcaagatcagaatgcgcaaacaaggtggaagcagggcagatatgatgaggatggcaaacccttcaatcaaagatctttgcttttggggcatgagcgaattctcacaagagcaaagtcttatgaatgcagtgaatgtggaaaagtcattaggcgtaaggcatggtttgatcaacatcaaagaattcactttttagagaatccttttgagtgtaaggtctgtgggcaagccttcagacagcggtcagctcttacggtcca

SEQ ID NO: 364845 - DNA, 526 bp, Homo sapiens
tttcttctgcagtggataggtcatttacatcttttcttgttatttggctaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgatgaatacagcaggggcttccttcaaaaccttaaccttattcaagatcagaatgcgcaaacaaggtggaagcagggcagatatgatgaggatggcaaacccttcaatcaaagatctttgcttttggggcatgagcgaattctcacaagagcaaagtcttatgaatgcagtgaatgtggaaaagtcattaggcgtaaggcatggtttgatcaacatcaaagaattcactttttagagaatccttttgagtgtaaggtctgtgggcaagccttcagacagcggtcagctcttacggtcca
